United States Patent 9,567,581 (SELECTIVE REACTIVATION OF GENES ON THE INACTIVE X CHROMOSOME) - sequence listing, part 35

SEQ ID NO: 4327 - DNA, 202284 bp, human
cgtctccgtctcattctatagccctcattccagcacaggatctcagcaatttttccctcttccccccacccactccagcgcgcagagtcctttcttctctctcatttacaacttctttttaaaagaaaacattttctagaaaaagggctttgctaaacagaaaagatataaaacaaaagccacagctatctagcatggcattgtcaccaactccctttgcatggtgatgcgattaaggtagcagcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggtaggtgaaacgactttgcatgttgatatttaaattgtttaaaagagaatgtgtcatgtaattgtgtatttatctgtgctctggactatattattttaattttatagaggaaagttagatatcttttgttcatttaaaacgcctaataattgtgggagggtggtaaatttttcacaaaagcaagttttatgatgcatagccgcactctatgcaattcaacacacattttcacagccaacgtgatattaaggtagtctgatgagttgcatgctctttacatttctatataagggtaattatttttctgaaagtaatttaaagagattattgggtgcagtgtttttcatataagatgattgtattaatttggcaggagcatgctcattttagataaaatataaaagatccctaattctcagccaacttgggacttctgttatatttcagaaactagaagcatactatgaggactacaattcaggaattttcttgaaatatcaaaaatttctttttactactatattctactattcaatctgtttggaaatggattgcctaccaaaatttagttaatatgacataattgtatttatgtacatatgagaagtggagcatgcataattttaaaaagtgagaaattactattttcatgcttgcattttctacatggtttacgaatagttgccaaatcaattgatacctcaaaatatcaaatcattaccagtaagtgaaatagtcatctaataacagagagtggaagactgagcagagacaggagatgctcttacaacaaagtataggactctaaatttaattttcattaaattttatggcattttttcacagaaccaagataaatggaacacatagtaataatgctatgaatactgggaaaacccactatgttcctttcaggtttacacctcctactatgattaagaaaaaatataggctggtttttattagaatcatcatcatcatcatcatcctcaccaccaccaccatcataatcaaataatacttgattaatcagatgaatctgcatatgagaatgtgagtatttatgcatgctcatatcaatttttaactcctacaaaatatttatatcatctttgcacttattttgaataccccttctttgaaaagctggcaagaatgtggtattttcttagtgatagaattcataagacactatttgttaaactattgaaaacaaagcttataaaatacatactttagggaagaaatttcagttaaccactatgtattgtgaaataattaattttgctacaaaccaaatatgctatgtttaataagctctttattacttttaacaggaaaatgaaaatctgagaaatttttcaccaactttcagtgttttggtgataaaaagtcaaaatgatttagaagtgtgttttcatcaatattttttagagagtcaacaatttaaatgcttatataagcatttaatatataagcatataaataactgataaaataatagaagtcatatacatgctcattgttgacctattttaaaaagaaatgaaatgtccaaatgaaggttctcttttagatatcacattgaaaaatattaatagttgatagttggattagaactagcagatgggaaaaataagcaatgaaataataagtttgttctgcccatcttattatatatttcttataaaaggtagatgacttatatttagggccgaaatgctgaaacaatttttttaagtcagatagaaatgattttaagacaatcacatgaatttaaaaaaatatcatctcatttctctgaatagttttaactatatatacataaaatctacaacctaaaactaaatacattgtctgttctcaaacatcttatggttaaagtttggaaacctgggtgacgcgactcaggatttatagttctcatcatttaaagttaactttagaacatgtacaagttcagaagttggccaaagagtttggatttttctagttttcttcatactaacatatcaaatatctttaccaaaatgtaaagttaaaaatgcagtgagcgttagctctcaagggatgcaaatgaaattgttgctaaaagagttaatgatgtgtttaggacggctttctgcaaagaccatgactccaggtctggaaaacaaccttcacagaccctatctccttcagatttcttggacaagttaatgggaaggacatcaggatatgatgcaagaatcaggccaaattttaaaggtaggttccacttaaacttacgttaagcctttgagaaatcttctagatgtttgaatagttaactgaaaaacattttcagggcttttaattataaaatgaaaatgacaagtatagtgttcattttattttggtattcttttgcgttagttactgatattttcattttacctgtcacttcccacatttgaaaactttccttgtttgtgttctatttcacaaataaaactagtgtcataaattatggccacagtccttattttttcgtaagtgggagtgtggctgaaagtgaatacaagagcaagtgatagacttgacttgcttgaatatctaccaggatgcatgcaagattcagtggttactccaaaatatttggttttgattttaaatacctacatcaaagtagagtttaaatctctataaaatatgccactttacatactttcaggcctctttaatttttagacttcgtaagaagaggttctaattttttgttcctttttgtttaagcattctcattgtttatttgaaattgtttatttgaaatcaacaaagatcacagaattttaaagtgcacatgtcaaagatggtggatactttctttgttcaattagaagcaaaccaatattttttgtttttatttgttgaacattacaaaaatatacttaatagtctgcagaaatgctttttaaatatatttagtttatttttattctgaatcagaaaaaaagaataagaatcaattactaataactgaatcatgttgatgctttaatttttaaatacatagtttaagtgatgttgtctttttcttgtaatgaaatttaacataatgcattgtgaagtgtttataacattttataaaaggagaaacctataatgttctggatattatgtagcaattcatgcattgcttacttttgtttattagcaatttaatggcacacttttcttcagtgttgatttttattattggcaaatataagcatgaaaactaaattttaaattcatttcttctttaaatgttacacctctgaatatacccaggtatgggcatattttataaagaaatatgtcagaattttggtgaaatagtattttttaagtatctccaagagagataactgaactacattcagagataaatttttctgaaaaaaaaaaaaagatggtcatgttcatcccatttcttaattttgtggtcattgctttggaagtcaatatttgaaataaaatcttgtgagtaacaaactgagaaccagctttcaatgggattgctcattcatatatttatccactaagtcattgaacaacttttgagtctggactatctgcaaaatactaactgttgggtgctttgtaaaattgggagatgaaacagtttaggtgcttctatcaaaaattttagtggagggaggagatgttacatgaatacttttactattagatggaaataggaaagtaccattaggaaatacaggtaaatcactacaggattccaagaaatggaaagataatttcctattaagatattaatggaaagctttatagagaaggtccagagatggaaaattgtttcaagtttacaagcatcttctttcatagctgttattcatttctttctagaaatactttttcaaaagggcaggaaagtacaaagagtaataaaacacacccatgttgacattgctactttaagtgaccacacaagaatgagccatcatttccacatccaattttttcctggttcttccggggatatcacctttgggaaatgatatttatcatggttccaaaggataaataaatgaggagaatgtcaggttcagcaaagtgtggccatgtttttttttttttttgatctatctactactttaaagtctaagtacaggatattttaatgacttataaaaaagaaatggggtggatatcacagaagactctaacattagtgggattcattgagttttatctccctctccctttaactctccaattcaatgaacactgctaccttttcataaaatttatttacatagaccatttatatcagatcaattatctgacatctcccaaagttctcttcatttgggggagcttgattattcctggatttaaaacactccccattattttagactacaataattttttcttgatgttcccatggaattttatatgtctaatatgatccttctacatatgtatattttattgatccattctcacaccacatctgagagggcagggaagtaccttattttatatatacatacatacataaaatattggtagtgtagggaaaataagtgatccttttctccaggataaggaaattagaaccaagacagagaggaaaaggtagatcaattaatgaagattagtgcttccaactggttgttgtagtagaatgtgagggtggtaacttttgagagaccagccagtagtcatagtggcaagcaaagatgatcttagctgaggtgaagagaaggaaagaaaagacagagaaaatagggaacttgtaacaaggaggaggcttagataaacactataatacttaccatagttgattagcaatgtaccaatgaggaatttaatatagtcagtagaaatgaagggagattaggaaatgtgaatgcatacagaatagtaacggtctccctgtaaatgtgaaaaagcaattttctgtgataactataaacatgatagtgatgatgatgttgacaattaaaataacggtgactgttaagaagatagaagggcaaaatttgaccaccagaataaaatcaagagccaaatatgggccactgaggtaaacagaatggttattctagaattcttattaaatattagcatatttctctgttttccttgctgccctgcattggcaagggaaaaagaagtgcataagtataatttttcttattggaaagaatttttcctgtatactttcaagtcagtaaaatattgcatgtctattccatattcctgatgggctttgaaagatgtcataatgggcatatatataagaaggaaaaatggatgtaagctagaaaagataaccaccagaaatgattcagacttagactctgtaattgagagacattcttagaaactacagggaaaaaatagcttttctgatgtgttgaagcacaagtgtataaacaaagtcatgagtcagagttgtcaattgaattttatctataagatccatagagacgtgtttcagatcttgtcaaaacatacatttaatgaaaatcctcaattcagataaaaacacaagctatatccattcacaattacctggttctgaaaccatggtaaatgttgattctatatcaagagatgaacctctttccccacttaggtgatttgtctcattttcagttgatttatcatggtgttattccatcatcctatcagatattcttctgtcagtattattgtatcttgaaaatgcactttaaacattaggcttttaatgaaatgttcaaatctgggcaaaatgcattagttccatttctttctttttgaaacaaagcctttatctattttaatgaaattttctttgaaaataaaattaacttagcgttacatcctagttttcatcccaatgtgaataaatacatttcactaaaacattctttttgggatagaatctagagtagataatgccaggagataattattcattccacttctttgtgcctgccatgcacactatttttttcccacatctagagacctaagttagaaagtgtaatgtgtgacattaaaacctacatttgcctgaaatatgtttttctgcaatttccaaagagctagcagttcaagaggtgtttcaagtatcatagatccacttccatgaaaccagaggttttcagattttgcccctggaaaatgatcatgtctgtagtcaagtggagctaaagttcaaatgttgtgaataccaacccctgtagaaggtgcttgagcacaagcgtccaccagggacacttggaaagggtgcttctttaagttagtgacaatgcaaccccagcatcgccatttctttgatcagcctggttggcatcagacattactatggaacctgagaaagaagaccaaaatgcttgcaagtatcagaagcattgtgcctgagtgcagaaagtagcagaagcctacaggcacctgaaaaagtaacttcatggccatgctgacattgtggttttattaggaaatacagacagtaattggttcaattataaatcaccttggaagtgattatggaattatctggattatctgcttgacagttaccttcctcacagaagaattcttattctcccttaattctaggtctcccttaattaatcaagaggcctgaggtaaatcactctttaatggctgagatgaaaaaaagccctaatggcactaagcccacattgaaaaatatgagagtcattattaaaaagtatacagaaaaaaagagttttcaggtgtctacgaatgtcaagtatgagtcagagttgtcaattataaaacttttaaaatgataagaatacagcatatgattttttgagacattatcttttaattatgaaagcagtcattttaaaatggcctagaactaagcccaattccaagacagttgacactcccattagggcaattactcttggctaaatacataggctatagttatcagtgggaaccattcattgaagaaattaaaggacaactaagggagaatagaaagaaggaaaggaagaatagatttattttaggacaaattattataaaattaccttgcaaagtacatatagcatgggggactatgtatatattagtatgtctatatatatgcacaaatgttgtgtttgtatatgcaatagaatgtccctaaaagatacacaaaagagtggaaatatcaggtgcttctgagaaaggtgactggatgccagggagatgggtaggaagaaaagttacttttctctgcatgcttcttgaatgctcatcattatatgtatttccaattcaaaagggtaattaattgttaagcacttctagagaggtaaagctcaaggaagcgcctctcttgggtagtatggtccatggtggcagattagagtcagtgtcactcttactttaagtgcagtaacatgcacgtggcctgatttcaatagtacccaagcccttgaaagaaatcccttgtccaataactattctaacctagcttgctattataatggctaaaattacagcactgttgcttctgttcttggattaaagattttatttcatattaaaactacttgatggaaatgacagtaagcccaattagtattttactccataatttgaatgagagtatttggttgtagtctggcactggggaagaatattgatggtgcaaggcattataaaacaaggcattataaaacattatcaataaggaaataaaatattgtttccttattgaaaggaaaggctgggagtaacaaagggaaacatatatgatagtttcattcagagacaatattgatgaagatttttgaacatcaaaaatcactggctgtgtcacaatttattatacaaatgtgttggttggtgttcatacagcttttgtgtgctgtatgaacaccaaacaacacatttgtatatactaggctcctactatggacccacaaggtttttcagggatttgaagtggcatcaagagggcatctacagcattctaatgcaccctggtaaagcatattgcaataagtttgtcagcatgtctttcattccatggtgacagggtagtatagtggaaagagccctgaacttggatctagaagacctaggttcaagttctggttcagccatttttgagaaaagatgtcttcacctatctgtgcctcaggttttcttctgcctttacctacctcacttgggttgtactgaggatcaaatgatatcatgagcatgaattatttgttttcaactgttactattatacagataatttgagttattattgcaattccaccatttttctttcatagccaacacttactgtgtattgtgaaaacagctgcttgattttctaaatggaaagaaacaagttagagaaattcgggcatcttagattcctaccagagtaaccataatgtagaggtcataagcctcagttggttttccttatattagttcagtggggaaatttccaacctgaaacggctatttcatattcctaaatataaaacaatgagggagccatttgtgggaaggaattatctttacccattcaaatcccatctctgattattttcttggactcattttaaaaaataaaccaaataagagaaatagaacaaatttaacttagtcctataaaggaggaccttaaatttaactgaagataatatgactgccatttctgatgtattttcttgtccagttactatagttgcaaggttcactgcacaatagtactgagatgatttcctattttagaattagtatttaaaagagagcatttggtctcacaacatggcaggttaagcgtaccagaaatggaagcccataatttagtctttgagaaagtactgcattgctccttggttgattctgggcgaccccatatccttaattttcattattgaatgaacttaaatattttatccttagtttatagaccttgctggtcctccacatcctgaaggataattcagtcaattttgctgataatctgagacttaaatggcatcaatattcaggtctcttggtgctcaatgaatggacagtataatgtgttcagttggggcagttaggtttagagtgagaaaaaaaataagtcattagtttgttcttgatggtgttggatatttttcttggtgtgttgctcagacactgtggaacagggtcttaaaaatgtaactatgtttgacgaagcctcaataacaaggtctttggaagcattctgggctccctttggaattaacgcctaggatgctgtcctgactgttgtatgaagcgtttgctcattgatttctttcctgagagagctactctgcacacttatgactgactacagacactttcagccatgcagaagccactaaagggagcatatgagcaaaaggcataggcctcaaatggatattctaatgtgtgcagtacatgtaagaacaaagtcaccaggttactcacttggagtctagtttggccagccaaccaaagtggttatgaggtaaatacaagagagaagctggaccctttctttgactcatgctatggtttgtgtatccaccattccattattaatatgatacaccaaatagtggctctgtatactcatccaaagggcaaaataaattctggattcagtaaaagtatgaaaagtccataggcaattatcatttgagaaaaggcatcttcacctatctgtgaagtatatatatgactggataagtcttgttttctattttttctttttttctgatgatggtggaacatattttcttgtggggaagaaaagccacacttgcctatgcactgtcaaagcaatagaataaatttgtggcaagggagcataaatgtaggcacaaagaattacatgtaatggttttacatctttatagttgagtctaaaaacacagttaatttgttaattattttaataaataattagtgactagtcaccatgtgccaggtaccattgttaggtgctaagtatagagtggtaaatagaaatttaagcttttaaatgtcagttcttactattactatctcacttaaataaaaactggaatataatttgtaggttgaatgcttattatccaggatatttgcaggaaagagaccacacatttcaatggtgtgagagaaaaaaacaacccttaaagggagagtgtagtattctgggactatcaacagaactgaagaagcaagggagggagtgattaccagaacctggtgaaggcagctatacagaagggtcacctaatgaaacctgtggaggaatgtagtcaatttgtgctatcctagcaggaagtaagcctgggaataaatatccagaccttgccctcctcctgttttccattctcctgtggaagcctttcattagccagattcaactaacagtcagagagcaagggagcccattgatacaaaccctgaaggacagtttcctagggtacagagaatagaagagaagagaggggttggggtggggaaatggaagacaaccagcacaaatgtcaacttaagagcaaactcaccccttaccattcaggtggttgagcagacatctccaacactgatgacaaatttagtaagccttctttgatcagtctggagaccatttggatatattatcccaatagataagtgctatccccaaaagcagagaagagagagaaatatagtgtaatgtgattgttctgtctcctaaatagaaaacaggaagaggtgcaataaatggattggagtatacgtgtgtgcgagagaaagagaaagaaggacggaactggggagggtgcaaggtggggaggaaagggagggggcactagaaataaagggagagagacaggaagagacagaggggagagaaagagagaaaggaaaaagagagcaagggatagagagagacgcggagggagaaaaaaaaagagagatcttcctgtggagcttacgaaaataattaatacagtttcctttctgtctgatttaacatatttgctaatattaatgtgcttgtccctacagtaattccctccaggctccccatgctgggatgtgttgtgggtttggatttgagcagaagatttaatgccaagtctctctggggaagcatttttgagataaattctttcccttcatgctcttctgctctgcatagaccttgagaaagggtgttagaagaaaagattgggtaaggggttaaaaaggcatgaagaccaggggcagagtagtgtgcatttccaggaaatggagagttctgggaacagttgctcatttcccactccttggctggtttgattatcacacttgaaatacagctactcatcttggcaattctcctacgttaggaaaagcccaggactactttaccacacaatttttacttcatttttaaaccaaacatacacagaaggtaatacaatgtatcttcttctaatttatttgcatttaaatacttcaagatgttgatttctaataaccacttcatgaccaacaagacagtcaagatttcttttatcaggctttctattagaaaaagcattttgcccatttcccaccacccaaataaatgtattcagaaaacaagggatccgtttatttatatttgaatctcagagtctctgaaaagtgaatgaggcacacatttggcaaaccaaacttaagttagattatgtgattcaggaaaatttataaatataatgtacggtgctgacaatggatttctcatattctactttttcctttgaattaactctggtttattacataagtttgtatatagtatgccaaatcaaaggatttaggatttaatactaaaacaaattaacaaccaaccagatgtgtttctcaagccatgtttttcagaagacctgattcaaagccacctgagagtctggttaaaaaggcaaatcctgggccccacacctctccatctacagaatatatggatgatgggatcttggagtattcattttgtcaacttaaatctataaatttggaaaaggaaaggagactttatttcttgtaaagggttatagtctgcaaagtgaccatcctgcagcctgggaagcatgtctttggacaagaccagagacaggcacttcaaaggaggaacggttggtataggagctttatgttgaacaggttggctaaacatacatattcaacaggttatagaaggctacgaatattcacaaaggtggttctgatgcatgtgtataaagcaaacatgcatgtaacatacaacccatgttcactttgaggtggagacttaacatttaaatgtcttacaattagggcctgtatgtcaaaaggcctttttaggacacagaggcatgcaagagtgatctctttaaaccagccagaatcatcagtccatggttggtggtcttcttattaggagaaagttactgacatcagtctcttgtccggtcaaagctgtagttatggttgatggaacaggggatcagttagcatctgtgaactggatgagttgtaattgttttaatattgcttatcttgagaccagtccttatttaactgctagagaagaaaaaaaaaaaaccctgtggcagttagaacatagtttattctttaagtgtaggggtgcatgatttaccccttgcctagcatggtttcaggtcctgtatataatttcatatctcattgccacaaagagtctgttctgtcagtcttatgatctctactttaacattagtgctggtcagttgttgtgtctaaacgccaaaagagaggaggtataatgagttgtgtctaacctcctgtcccattgtggctgggaactcaattttaagatttttctggagtccccttggctacaagagggcccattcagtcagtaggggcttaggattttaagtttacaactttaacaaagtcattactccctacaggttaagacctacaggactagaataagacatttttgcccttatatcagaaggatgataccttctttatagtatttttcccaagatcctatgtgcctatattgttttacgaaatgaagggggaaaatcccacaagagaaaaaaatatctaaatcgagactcatgaggcctgattttaactccagttttgacaattatgacctggagcatgccacttaacctctttgggagtcactcttgtcatctgcaaaaaaaaaaaaaaaaaaaaaaaaaggacttagaacaagatgtctctctacttcacttctaactttgatggtccctggttctaatagtctaaattaatatctttgggtatatccttttgtaaattgttgactcacccagagaacttggatgcacccaatcttcctagataatgtttcctttcttggaaattattaattctgtccagcatttttaacagttgtctctaccttatttcaagtcccagtatttcattcagaattgttattgcagggaagaccctggaaacttatgaggagattactgaagaaataagctattacaatttttgccttgctcttggtttggaggtagcaaattcatgtacaaaggctgcttctgggaaatgtagctaccaagtttctttaattcagcatctggccaaagatgtttcccaaaactgtagtccatgaaatgttctctaagtttttaaatgtaaaataagtataggaaattctgcaaaacatcctctgagagagacttaatatccattagcatattaaaaagttgtgagaaaatatgtagtaaaaataaatacacaaataaatattttaaaaacttttttttacacaggggtttgcttgatattcacttgatcacagattccttatcatgagtaacatcctggagaaccagtgttttatggaatattttggaaaatgtagttttggtaaaatccagaaacctaaacaaattttgccatgaaaatagatgatggggaacttaaacatacataaaatataataatttgccagaaagagaatattcataagagtgagaagggcccagcattcagtaaatgaggctttcattttgattcatggtcaacattagcattatgatgccacaagagaattactctacaagttagaatattattgcagtctatttttctcctgcttcatctacatgaataaataaacaaacagtggcattttgaaaagcatagagaaaagaaattagtcaatacatcaaaatacttggatctaataatcacctactgttttagtctttatgatttacaaaagctgacaaatatatacatttaaacaagtgacctttaaccttgaattagagatatttcttcagcagtatatgacaaagtttcatacctgtatgaagaattttcttttggattgctatcttctttctcaggcagctttcaaaaaatgggtaaatcttgtagttgtgcaatttccactcatttgctgagaatagtttttccatcacttccttgcaatgaaattttaaaaatttaaatctataccaaaaatctcatttaaaattgaaattatgcaatatttatcttaacttgtgcagatttaagattaacttcctatttattagtattaaatcactctaagtttctctgtttaaaaatgataatgtttcatatacttcaatatataaattccaaggaaaaactattgaaaattgtttgcaatgaagatggatgcagaaaatgaaatgtctttgaaatatcactaaatgtcttggggaaaggatgattatatatagatattcttaaatataatatatacttttaaattactagttcctcctccatgctttctctgagagtgtttgtcaagtaagcaagcatgattttttttcttccttcttctcaatccaagctcttaggaagagataaataacggagtaggggtagggaaatagtgatgccacctcagacttaatcaatggctcctgattcatgtcatttattttacacactaggtgaaaacacattggtgatggagcccctacacattctatatcaaactaatcctttatttgagacaaagtatccacagtgatgacattagcattgctagtattccactgtacagcccacagataatgggataccaattgtcttagtgcattttgtgttgctatgacagaataccatagactgggtaattttgaagattcgagatttatttcttacagttctggaggcttgggagtccaaggctgaggagtctgcatctggcgagggtcttcttgctgcatcatcccacggtagaaagcagaagggcaagagggcataaggaagaaggggaaggggactgaattcatccttttatcaggaagccattccagtgagaactaacccactcctatgacaatgacattaatccattcatgagggcacagccctcatgacctaatcatctcttagaggcatcacctctcaacattattgaattggggattaaattttcaacacatgagctttgggggacacattaaaaccacagcactgattaagtttgtcttttgattgaggttggcagtcttagatacactgcatcttgaagaagaactgaataaaggttaactataaagaagttatttgggcatgcacacatttgcttactttgagttcaaattttgttttatataatctgagtgcctgacttagatcctttgctatcatttgcttccagggtcacagcttctccatttccaagggacagacggtgtcattagatattggggtatgagaaggtggctttgctgaattattagttatagatgtcaaggaatatgaacaagaggataagattttctttggaatcctgagatttgctttccaaaggaagtatatacagtgtgttcccaaaatataaaaatttaagacatcatccctgtttgaaaggaaatgttacatatgcccagggtcatgccttgtgaataggaagccctggcactgaaaatttcacttttttcagaggcctttttaaatagatgaatgccaggctacctgttctctccaaaatctaaggtcacagtttgttaataaggttgccatactattcagtatttattttatctgaaatattaccatttcatttcctagaatccgtgcccactctgtaaccagtggcatgcttaacctgatctttatcaaactaatcctatattatcagatgtatttctctagctctcccaacataaaaggaattatccacagtctggaatatgtgttccttttatttcccccaagtttctgactcacgtttgtttatcatgcacatatgcctcatttaagtgcatcctttaatcaaatattctgagcaaatattcccacttaaaacccagcaggcggcttcctgttccatagatctcctgaatgccaacaaagtttataacatgcagggctttccgcagagtgtatgaatttgtgacttggggcaaatatcctaaaccctattaaaaaaaagatttccttggcaaaagaatacacttatctcaaggagaaaactccacgattctacttgtcaaccagctctgcaaataggataattacacacgtgggatttttttttttttctgcctacagttgaaactgggtttgcaaatggctcctgggtaaaaagtattctatagcacctccatctcccagaatgagttcatttaagaggtgccaatgtatagttaacagcactgtagtttggctgaaggaatctttgtgatgctcagtaagagtggattgacatgtgaagctttcatgattgagttattccttcatcatggggcctctctcattcccccacatattgaaaagaatataattattacataaaaatttggagccatgtgctaacaatatgtgccataataaaccatgcatacataaagtctcaaataagcaggtaccctctcagtgtctaacttttcatataaatgccagaataaattatctgcttcagtgatagagcaaagcacttgagggtattaacaaaaagtatccatcagtgacatcatgtaatatgctatatacatcacagaatgacacctttaaaaaatattattgactttagatgggtgatgtggcaggtgcaaagaaggcaaagaaataaagatgacataataaatagatcctaaaggaaagctaagatcaaaaataaactcctgtactttttttagaaaatccatagtgcagctgctctggggtgcctgattgcctatatctttatctgaatgcacagaaaaaggaagctgagctgtcacccaagggagtgcagagctcaaaatactagtatccttgatattctaggtctctcatgacccttgaaactctcctaggccttctcatcatttttggataaagtgcttgcacttgtacatgtctcacaaagatctctgtgtttaggttctttactacatctgtctgaggttgagtttccaagaagcagaccctgtgcaaaagagatttattaagaataagcaatcaggggagacatataagagagtgaggaaatgagacaaagaagtgggaaagccaagcatctatattgtcaatttcaacatcttcattccacatctcaagccacaccttcccactctatgttccagcctcgatgccccatttgccattcctcaaaccttttatttctggtgcttggcacttgcatttctctctaccatccctgcctttccaacagcttactctctactctgacttcaggttaatgtcatttcctctagaaagcctctcttaaactacaaatcccaacctttcctacgtgctcagtctagagtctatcttgtgattagttgcttctctatttctttccatcctagactagttcaagaaggttaggattgagcttatctcattctacattgtatctccaacacgtgacagtaggtaggttgtcaatagacatttatcaagtaaatttaaaaattgataacactaatccttaatctcagaatctgtaccaatgcaaacttgaatattaagaactgaactaagttattattatctgctaattattgtgattcacttaaaattcatgaagtccctccatatgtatcatctcatttgactcctcactgcattttcttgaatagaaaacagccagaattttatcattcttgttatttaggggaagaaaaagttatcctgctgccaaataggacttggacaaacactacctttccttatatataacctaggatggaggggagtataagtcattagaaaatgacaacagggacactcattccccatctgcaatactttattgaatatatttgtaacacagctgctgccctttctattacaggttgaattgaatttatctttgaagccccaggtttttgtgcactttctgtttatctaggagcttaataaatatttaatgttgagtaagtggatttatttacatgtagacatgtatcacgcatttattatgcataggacactgcgctaagtacaaagtagagggtgattcaaaggagaattgttaacttatcagcattctaacctgcaactttactatcccaccttcttctactttaccactatttcagtaccaatatcccatttataaaaagttttcttttccatgcctaataccgaacatggatggatagtgacatctaacttatccaaatagaatccctggcctaaggcactctcctactcagtgtctgcagtgttcagtaaataaaaccaaaggcgcataaatcatacatgttgataatattggatatacctgaattgccagggagttctgactgctaaagtaatttcaggttcacttcatggttatggcccatacttccttccaaccagtgagtctgtggttgggcatcttctgaaattctcctcttgagcttcatcttccagctttacaaaaaaattgagtagttctcaagtacaggattctcccagattatgaggcagtgaaccaaaaatctttacaaaagactaggggggctaactaaggtatccactaatagtgatgacctttatttttctctagagggcccgtggtacaggagaactcagttcactgaggaggaaaaagaagtagctctaggctttataaaagaggaggtacttgaatttggtattgagagcaaataggtgttcaatgaatgaaaaggggaatttcagatagagaactgtccatgtctggaaagaacattgctagtttgggggataataaaagatgagtatctctagaggaagtgaaagggataaatcatagaagataagcctacagaataaagttagttaaggccagaatgtaaagaagattattgaagcatagatttaaccacaggtaacaggaaggcaatcaaggtttttaagcagaagaggagcataattacataagatttctaagaagataactcaagatacctttcaaaggatatacgaaaaaggtaagggaccagggttccaggacaatcatccacaaaagagagatgatgaaggtttgggcttagggagtggcaatgggttagaaaacgggcaagattcacaagataaacttaaggtaaaattgcatcagacaagatgtagcgggtacaatagaaagagtaatgtttgactcaaggttccattttgagcaactgagcagacagtgattttgtttattcatgtcagggacacacgaggatatctaatctacagttgaaaattttaatctggagccaagaacagataccagagctataaatgtaggaatagtagtcatcatataatgacagtattgctaagatcacccagtgagaatgtgtagaataaatatagaagatgaataagaataggatttccatgagcatgaacattgaaagaataagaggaagagaaggactcaacaagggatacagagaaagagtggttagaaaatctggaggagaaccagaaagagatgcagtcattgatattaagggaagagggagttttgcagatgaggaaagcaaccacgacaagtgcagcaggaatgttgagtagaaagaacaagagaggtcattggatttgaccactgggacatttttgaccttagcaaggccaatttccctagagtggtgatacaaaagcccatactgagttggtagagtaaatgagatttgagaaagtggggaaaagtaagtctgtagatttatcgtttaaaagattggtgccaaagagaaagagagggattgaatactagattacagaatttgagggaaaggaggtttttttttttttaaaattaagatgagaagggtacatttgtagaataaaggaaagggagactgaaagtacgagtgagatagaggataattgatggaggagagttctggaaggagcaggaggaatcaatctcataaggaagatgaagagattacctttgcactgaaggaggaataccatttccttactctgataataagttttacaggtggaggggaaggtagtcagataagttcacatccaatgatctgtattttcttggtgaagtagtattctgtcatctgccacagaagggctgctgccacaagcatgggctggtcctgggcacagtcaccatgaagctaaaaaagagcatcaggcccttgatgctttgatacctgccatctttgccgccaggacagaccacaaagattcaaaaagcatttaaaaattttaaacacatcatgaaaacagacttttctaaaaaaaatttatacttctcagttggcttattgagtaggaagatattttatgtatttcaaacatatgtcccagaagatcaagccagaaggtattatgcacaattctcagacaaaagatgaacagaagtaaagggacttagtgtccaagttatccatcagctcacttcttagccagtgctttattcctcactgcacccatgcgtatatttcacaccattttcattgtaggaactcagaaattgttaataataacattgttggtttatattaatgagtccttactatgtgtcaagcatttaagcactttgcatattaactcatttaatccttccaataaccttacagagaaggttattatcatccctatttcacagattacaaaatagaacagaaattgtatttggttgcttatggtcatacagctagtaagagtgcagaaatggcttttgattccaggcagtctagcatgagtctgccctcagtgctattagtgggatagtaaaaaccttaaagatttgtgttgttatacaccaagcctataatcatttcttaattacagccatgctaggggcttgtgaatctggaggcatgcctaaggatgtgtttattatttaactttacatcctcagatttgagcacattaataatcctccataaatatttgatgaataatcaaatgaatgagcaaagatgatttctctccaatcacccaacagctttctgcttgggatgtattggaactagattgtagatcgtggggtggaggtatggtaaagaacagttggtggctaaggaaaacagaagagatacagggactacttcctccatgggctacacattacatgactttgtctctgactaacggcattttgtaaacttttttttacatctttgagtgcaaatttgtgatgtacttaaacatatttcaagaaaatgctatgatataccaaaaacatgccctttcatatgagattttatctagtcctatagtttgcttctaaatagagtttttctccggaccctaggaatgttttcatttaacaatctcaaatcatttgggcatagtgagagaaaactgtaagtctgagacatgaagtctataatttattctcttattactttccaacacacatgaagagcccaagcttgctcagggaataggaaagggaaaagtctgggggctgcttgctgggatgatgttccttcagaactaaggagaatgctctctgaaataatttacttgttcttttcttaagcagaggaagtacttgctgcttatgtacaaattcaagttaactttgtagtaaggtacaaattaattacaaagtatttatgagggacatttatgatgtgcctaacgtatagcaactttgagaacttacagaagcagtgacaggcaacttttgtcctttagcaatgcatcatcttcctcagcaaatgaaataacagacataaaacaagtctgagcaacagaagccaactcctctctatataattgtacagctatatatggaattatgtcatggagattagaagttctgaataaggggaattgataatggccgaagtgtaaggaagaggtggaaaatgacgtgaagacttggagtatgggtggggtatgcaaaggcaatgtgttcctcatgatgtgcccaacaacatgttaagtgtgtcatatgcatgctctcatttgttctctacaaaattgataagtactactgttaacgatatcctttttccaaatccagaagctaatgttcagaatccttagagctggcaagctgtgagagacagagaagctggtcaaatctaggcagtctggtgctgaggcccacatactcagcaactgtactacaccttatggtggcctaggcaggctaatcgtgtctgcgtttgcaaatatacaggtcatatgactggagatgaatgttttgagaggtatgcatcaacccaagccaataccccaaaagactcttagtaggattcttcccctttgacctggcagaccttctacctccattgcctgagggtaggagaatgaggccatttctcatcagagggcttgcttttctatagtactgctctattgtgtctggtacaacacacaaaattagagactctttaaagcctcaacaaaccttgtctctagcatgaaaagatcatgggtaaaaaccctattctgtttcattagcaactctcatgtcctcaaattataaccctctcaaggtcccaaggtgatgtcactgtctattatcatgagcacacaggcaatgatggtgtctagtgggagaatgacctcctcaatttcaagtgtgaactcaactatgatgaatgagaggaggccgtgtggcttcttcaatcttggagggacaaccgtattcggcttattatcagagattgtctcacattgagatggaggtagaaatatgtaatatcaaaatccggacatagaacagtttctccatcacctcaagactgtctaacaatacaaaatgtggtggccttcaaatcagagaaaggatatgcaataaagagcaattatgcagattcagccttcaattgctgattatactttggctagtgatatatactcactatgaaatagagccatatcttccccctcctctgcacatgaagagatacatcaatcccttgcaaagaacctctgctctcctttccctttctctttttctcatgcacaatttgttgcctcctctgccatgttcccttaaacactattgttattatcacatgacattgtaattagtctaatccatgtctttctgccttgatagatgatggcttttttttaatgcaaagattcagtacattttggtattcccaggagcttacaaggcatcagtgtctgtgtctttcccatatccccggtcccttaccacatcaacctgacttctacatggtagcagctgcatttcttcgttgagggcattctctgatccaagccattttgcccacccttgtggcagaccagaattaaaggtgaattagtgtctcctgagagtactctcatccaatgactggtggaaatcaatttaacatacaccagctccttctccccttgggcagaatagctctgaggagtccttctatactggcttccagagttgctcatgggacaaggcttcatttgccatcagaaaataatggacttattaacacaccttttattgtttgcctaacctgtcttacttcccgacgtctcatccagcatattacttacatccctaacaaatgactttcacctaaatccttgactcgaggagaacacaaactacgtaagcacccaatatacagaaggacttcaataaatgtccttttaataaaattgaattacaaagatgcatagtgtagcatgagataaaacgtggaagtgctatgctacgtaagtgctgggagcctatcagtcaaatttgagcacttgtaaacacaacaagcaccatgatttcaggatttccctttgcagtgggaaggcggctgtcctagttgttagtagagaagagtacattatcggaagctctggcttctatttttagacctcttgctgacatagaaaacctgtttcctaacagtactgtagtgaccttcccaccctcagagaaatggtgcagaatgcctaaggaagaaacaagtccccatttgtggaagccacagaggaacagaggagggaaatgagagcttaggtactattcgttggcagacatggtgctttaagatctcttttgacagctaaatagaaagtgctgggttgcctggcagtgcagtggccttgaacaggatttaggtctccaagctgctaaagcttggctctgagcccaagatgtccaaagagcaataatctctttcttttttaaaaacctcacatgaaaaaataattttccaaaataaggtaaaatcatgactcttacacagttatataattaatacatgttaaagattttatttaactcattagtcaatgagggaaccaggcagatggtataatcagttcaaaaaaaacctcaaagaacagacacatctatagataaaaatattgaaataaatgtgcaaatggaggcaaaattagcctcttccacagtgggggaaggaagtcacttgaacctctacaggacagaatttccatacctataagcaagggatattttgtattactattagttatataatttgcagagttttaaaatagctcccatagaatcagagtctgataacactgaaaggtatgctgtatggacaatgtatagttttttactgaagcataatttttccctacactcacgatcgtttgatttaataatgcaatatttctccaataagggggaattagactttttactagagcttacttatacttttaaaatccagctcattttcttaacactgtgtatagggatgagagtaatcaaatgcagggcagagatactatgcttgagaaaagtacatctgattgttaagaaaaagatctcaaggtttaggaggaagatccttccttgataggggaaggaaagagatggtaacagaaaagaagtagctgatatttcacatttacattatctcattcagttctcccaatgaacttgagagttaggtgaagatatttctccttttataagatgaggaaatgggagcccagagtaattaagtagcctacatagggtcatacaaatagtatatagtagagccaggatttaaacccagtctttttagccctgaagtttatgattttcttccattatgccatactgtactggtaaaggatgatgttaggatggagggcaacggttaagactttcctgatccccacctcaaacagggcagttcagcagtggtatcgaagaagcatgtagcagtgtttctcattggtgattgtcatatttttgtcataattttctcattctgttgagtgctctggagagataaacagaattggcttctgatctcataggtttagcttaaacatttgatttaaatgaattactttttgaatgaattactttttgaagctgaagaaatgaaggccgattaactgggttaaaatgccttaaaagttgttctgaatcagatttcctgggatgccactaaaagttccttacataaaaatggcttatattcttattaatagcatttattgaacatttactgaatgcctactatgtgctcagtactatattaagtgccaagggaacactacagtgaatcgggtaaaatccatgccctgtccagagcaaactagaaaagattagacacatataaaagtcgaccataatacaataagataagggttatagggttataggaatgctaggaaagatgatattcatatagggagaatcatgcaaaatttcatcaattaggtatcatttggctttggaggataagtttttaacttggaaacaaatgtgtatatgtgtgtgtatcctatcagccaattccattatcataactccaaacatagtatagtttcttcttaaaaattattaatgcaaaaaattctatttccaatttgtcagggcctaacaagttggtgaacttgttattcatagtagaggattcaattaacatgagagaaagtcatctttaattctatttttgttacttcctaaaaggaaaggatatgtcatttaggttcatgaaaaattctcaggtctttatatttcaaaactaattccaaatggcattcaaaatcattttcttctaaggctaaatggctctttatttattattcaccccaatcccaaatagcaagaatcccatgttttccagcaattctttgatgacattttattatagcataaatagaaatatatgtaaattattcttacaaattgttctcaacctgaaggttccatttagcctctgagatctttaaaataggaaatgaagcttgttaccacaagcaaagtgttctgaatctcccaaaacataaactgttcactttaaggtcactatgatcccgcaatgaacaaaaaagcagcagttcacttgtattagaaaaggcttagtaaaaatgccctctctgtgatgcttggttgggcagacacgttttgtttcatctgacatttcttgcagagtgactcaagagctattcagcaaattgtttctgacttgtccttaatgcctgattttcttttatttagcaccacaatttaccatctacttgtaggtcataagtagtagaagaccaagtatatactagacacataatgggtactcaataaatatttgttgatttaataagcgactgaggatttgtaacatgaaaatacacagaattcagcaaatgtctgcaaattcagttttctgattaacaaactcaacaaacgagtataagttctattatactgccatgtcttcacctaaagtatttctttttttttttttttttttttttttttttttgagacggagtctcgctctgtcgcccaggctggagtgcagtggcgcgatctcggctcactgtaagctccgcctcctgggttcacgccattctcctgcctcagcctcccgagtagctgggactacaggcgcccaccaccacgcccggctaattttttgtatttttagtagagatggggtttcaccatgttagccagggtggtcttgatctcctgacctcgtgatccgcccgcctcggcctcccaaagtgctgggattacaggcataagccactgtgcccggcccacctaaagtatttctaaatattttttaaaatccacactctttgctgaaacatgtgagactttttcataagaaagccatatgaccaagaaatattttaatatgatactagcatttgtttggtgaagcagaagagtaaactgaagctcatttcattattacataaaatgtgatctttgttaaataaacttcctactcatcctgcaattttaccttctttttataatttagtggttatcaactggggagattttgtctcacagaggacatttggcaatgtttagacacatttctgattgtcacaacagggggtgtgggagaagtggtgctactggcatctagtgggtagaggagggggatgctgctacacaccctgcaacgcacagaacaactcctaacaaaagagaatgatttagtccaaaatgccaatagtcccaaggtagagaaagcctattttaaaaaaagaagctggctgcaataatctcaaattcatgatggctacatgggttttccagacatgaagaatgtttatgcataattcccagaaacaagaaaggtataaaaggtggttgggtcctgccaagaagtcctgtaaagctaagaagaaaaaacaaaacaaaacaaagtttacagagaaaagagaatggaaataggataagatgggcattatttcagtaaagattggcatagaggatattggaagatctaagttgtagtctccaagatttcagtttatattaaaatgggtttgacaatgtatttcctacacaggcatatttttacaatccaatgaacgcacaataatgatagtaatactactaccattactataaataacagtaactacgatctattaaggaaccattacatgccttccatacattattactaattatcacaattatcatcaaagtaagcatcattatttctattctgcagaattaacaggctcagagaatttttggcagctgtttaaagttgacaggtggtaataatcagagttagtgttaaagataaaacagactagtagccaccatacttcaaatatatctttaagtagtatgacccaaattccaggttttctcaggactgccctggtttctgcctgattttcctgtataattattaatagcactcactttctcttaaaagtgatcactctttatgagatgatggattctctcttttctctttaaactggagaaatccacatcaggcaaatatagaaacttgctggcattctcaaagccctttgacatgtatctgagccatgtgtttatttgtccatttacttatccttgtgtgggagcagttgacaactggtggccatttgtgggaaggactcacagaagatgctatttggttcttgatatttaagctaccttaggtgttaattaattgctttgtctagaatttttttttttttttctgagacagagtctcactctgttgtccaggttggagtgcagtggcatgatctcagctcactgcaaactccacctcccaagctcaagtgattctcctgcctcagcttcccaagtagctgggattacaggtgcccaccaccatgccaggctaatttttgtatttttagtagagacggggtttcgccatgttgaccaggctggtctcgaactcctgacttcaggtgatctgcccacctctgcctctcaaagtgctgggattacaggcgtgagccaccacaacccatctgtatggcaattttctaatttctatcaacatggcttgtccaaagcaaatggtttttgatgagtccaaagctgtctcatcaggctgtgggaatctgtaaacatccagcatgtttacttctctgaatgttttaccctttgcacaaacctggaatgtcagcaaacaagctgaatgcagtaagactggtaaaaccatttgcgtatgagttgagcagaagaatcgatacataatttacggtgaattttcaaggagattaaaacagcacagtggcagtgggttagattgtggggccatttcttttttttttttttttttttttttttttttgagatggagtcttgctctgtcaccaggctggagtgcagtggctgcaacctccaccccactgggttcaagcgattctcctgcctcagcctcccgagtagctgggactacaggcgcccgccaccacgcctggctaatgtttgtatttttttagtagagacggagttttgccatgttgaccaggctggtctcaaactcctgtcctcaggtgatccacccaccttggcctcccaaagtgctgggattatagacatgagccaccgcacccagctttttttgtttgtttgtttttgtttgagatggagtttcactcttgttgcccaggctggattgcaatggcacgatctcgactcacagcaacctccgcctcgattgtggggccatttctaattacaatcatgacatttaaaaaatttctctattctttcagattaaatgacttaaattctctctcataaagggagtgccatgaagaaaagtcattccctctcccttgtgatcctcctatcctccaaggctctctctttcatgggcatcaaagcaccatgcaacgcaggaagccataataagaaacagtgcttactcatgttcagatatcaaggctctgacccttaactctacatcttcctgcttcttctgtgtgctttattttccccctttgtctattgagctaatggcaagaatctttatgctagacaaaatctttttattctaaaggaaatttaatttctgtatatgtcaagcccatatatttcatattctattcccatccaagggccacacattaaaacaattgtggtacttgaagacacattaagttatttatgtgaaattgcaaagtgaaaatgccacttttttctatttgtgacaagagagaaaaataatatcatttccatcttggaactcaaagatttccctctgttctcaagtaggcttttaccttaaaaggacgctgggaaataactaaggagaactaacaaatagtgactaattgtcttggtgttacacaggataccctattatttcccaatgtttatttttaaatagaatccatcacaatgcttttcaaaaaataatatttggccaggtgtggtggttcatgcctataatcccagcacttcaggaggctgaggtgggaggactgcttgagcccaggagttcaagaccagcctgggcaacacggtgagacccccgtctctacaaacaatacaaatttaaaaattagctgggcgtggtggtgcatacctgtggtcctagctacttgggagcctgaggtaaaagagcaaggctgcagtgagctgtgatagtgccactgcactctagcctgggggacagagagagaccctgtctcaaaaaaaaaaaaaaaaaaaaaaaaagaataatagtaacatttattgtgaacttagaaatctgtggtaaatacaaacatatatatatatacatacacacacataacattaacaagtgttttaaaatatagtcattatgaataatagaaaacatttttgttatctaggttttgaatatgcaaaatacagaagtctcatgtatgtttatgagcgatgtaagtcattataataactgagtcgtatatattaagtatttgttgtccatattatctggcttagccctgtttcacttccatactacctcctaacgcttgtgataaatagtgttctgattcaggcttgatggtttttcacctgagcccactccagtgcatctggctccgaggccatcatttcccatccattctttctgctatgactttgttcatgctacagagcacaatatcaaactcattgtagatagtcctacaggcagtccctatgctcttccatgtccatggtcagtcctcatttcatctatggaaagaccatggaatttataataattcctgttgttctctagcctcctagtctgattaggagcagggccaggcaaagttggcttacagaccgaatctggcctaccacctgttttgtaaataaagttttactggaacacagccacactcatttatttacatattgtctacagctattttcactacaaaagcagaattgagtagttatgacagaggccttgtggcccacaaaggctaaactatttaatatctggccccttaaaaaaatgatgttgactagggcactgagtttttaagacagctcagccaggaattaataactttgtcaaatccagttacaaatagagcttttcaatcacatccataagttatatctgcagactagagaatcataaatttagtcttaaacttatagataactgggaaaagttaagctgactttactgattttcctcttctattgcctctctatcctaggtacctactctgcagcccaaatagaacatttcttccttggcaggagcacagagttttataatagccctttgattgcctttagtcctttgaatagttctattgttatcatctaacatatatattgttcaataagaatgttttaattgaattaataaatgaaaaaatgtggatcagcattttcaaagctatgttttgcagaatgcttgctatctttgaaatgtgttccacgaaaaggatggtctatctaaaaaacaaaaaaatctatagtcaaataagtttgggaaataatgacacacactatttattttcaggaacaccatagttcacataggtgtattaaagttttggagaaagggagggtgacatcaacaaaacggcacagtagacagctcaagctctcaaaaagagtagaaactgtcagaaccaattttgtcagaactctggaaaacagtcaaaagtttacagcaaccaaatgtccacaaaatcaagaaaaaggtaacttcgaaatggtaggaaagttttgtggtattcccacttgcccttgtcccattccctccctagtatggcagtagttttggtttaaaattggtagcagcctacactcctagtatggggccctggtcccttgatctggaaggagtagaccaaaccttattcacaaattattttgtgtgtctgttctaacctttctataggctaccagaaggacaaatgcaaggagtttatatttgttttctagggctaccataacaaaataccacagactgagtggtttaaacaacagaaatgtactttctcacagttctgaaggccagaagtccaaaatccagatgttgacaggtttgctttcttttgagacttctctccctggcttgtagatatctgccttctcactgcattttcacatggtcgttcctctgtgtaaacacatccctggtgtctcttttctccttttctcataaggacaccagtcatatcagattaggggccaaccctcacttaaacttaactaaccctttatagaccttatctccaaatatggttacattttgaggtactgagggttaaggcatatgaatgtgggggggacacaattcagcctatgacaatgctcatctctgtttttacctaactcaggatggaaaggcagtgagtattaattaaaaaaatactgcaagtcaaactaaaaatcttaaagggcaaaatattacaattgaaatatacaatagaccatctaaaagcttggaagtgaaacttagagtttcttagggaaattaggacattcaaaatcgaccatgcatatggcaaatttagaaagccactgcattttcagggaaatatgtgtgctcagaaaagacccgagcaaacccttagctttcaccttgggctgatccctagattcagttcaagcccagctagttgttgaagggctctggcatagagccaatctgcaaagactgggagagttatgttttgtttgcttggttggttggttggttgattggttgctttgtattttggccccagatactcaagaaaatctctcataaaattctagttgaacacaggctgagaaacaaagactatagtgaccacacatgagaaggaatattacagtcttcgcagaaatagttttggaaagtcactaagcaaatggcctactatacccttcaacagtcaaaacattcagcaaattctagagaaggtagataattttcagttactacagtatgataaatatacagttttcaacaaaaatcacaatgcataaaaagtaacaagaaagtattggccaattcaaaggaacaaaataaattgatagaaattatccctgaggaagttcagacactgggcttactaaacaaggactttaaaacaactgtcttaaatatgctcaaagatctaaaggaaaacaaagacaaagaatgaaaggaaatcaggaatattatgtaggaataaaatgagaatatcaataaagaaatataaattgtaaaaaaaattctgtatctgaaaggtaaaacagaaattgaaaattcactagggtagtttaacagtaggtttgagcaggcagaagaaagaatcagttaatgaagataggaaaactgaaattgtcaattctgaggagcagaaagaaaaaagaataagtgaaagtaaacagagcctaggataccaatgggaacccatcaaatagaccaatatacacattctagaagttccagaagaataaagagtggaaagaatatatgaataaaaaaattttgagaaataacagttcccacattttatgaaatatgtaaatctacaaatccaagaagcacaataagttccaagtagggtaaacccaaagagatccacactgagacatattataatcaaactgtcgaaagccaaaaacaatgaggacactgtaataacagcaagagaaaaacaactcattacatacatgggatccctagtaagactatcaactggtttctcagtggaaaccataagggccagaagacaatgggatgatatatttaaagtgctgagagaaaaaaaaaaactgtaactgaaagtttatatccagcaaaactgtcctcaacaaatgagggagaaattaagacattactagaccagcaaaagctgagggagttcattaccacttggcctacgagaaatgataaagggagtccttcaagctgaaataaaaggatgctaaacagtaagtagaagtcttatgaataaataaagatctccagtaaaggtaaatgtatgggcaaatgtaaaaacactattattgtatttggagtttataactgcacttttatgtcctacaggacttggaaagacaaatgcataaaaaattattagttgattttattgtgcattcaataaaaagatataatctgcaacaacaaaaacataaaggagagagaatggtgttgtataagagtggagctatcgtatgttattgaagttaagttggtatcagagagaatggtgttgtataagagtggagctatcatatgttattgaagttaagttggtatcatttctgactaggttgttataaatctaggttgttaaatgtaattcccatggtaatcacaaagaaaatatgtgaaaagttaacacaaaaggaaatgaaaagaaaatccaaatggttcactacaaaaaaaatcaactaaacataaaagaggtcataatagaggaaatgaaagaaaatccaaatggttcactacaaaaaaaatcaactaaacataaaagaggtcataatagaggaaatgtaggacataaaaagctatgagatattcaaaaaacaaaatgatagaagtaagtccttgcttatcagtaattactttaaatgtaaatggattaaacaccctaatcaaaagacatatactggcagaatggataaaacaaaccatgattcaactatatgctatctacaagagactcactttagtttcaaagtcacaagtaggctaacagcagaagaattgaaaaagatattccatgaaatagtaaccaaaagaaagctgaggtggtatactaatgttagacaaaatagattttaagtcaaaaattgttaaaagagacaaagaatgacattatatatggagagagatctctaaagatgttctatttattattaaaaatggtatgttgaagtctccaactattactgtagaaatgtttatttctctcatcattttggtcaatatctgctttatatattttggagctctgtttggtgcatatgtgtttagaattattatatcttaatgagttgaccattttatcaatatataatataattgttttcaggccactaaacaagcctcagtaagttttaaagtattaaaataataaaatgtatcttttcccactatagtggaatgaagctaaaatcaataacagaagaaaaactggaaaattcagaaatatttggaaataataccgtcttaataaatcaaagaagaaatcacaagggacataagaggtgaatgaaaacaaaaacacaacgtaccaaaacttatgggatacagtgaaggcagtgcttagaggaaaatgtataatataaatgcctacacttaaaagaagaacaatctcaaatcaacataaatttacaccttgaagaactagaataagaagagcaaactaaacccaaagttatcagagaaagtaaataataaagattagaggggaggaagacagagaatagaaaaagagttgcagaataaacgaaaccagaagtttgttctttcaaatatcagccaaattgataaacatttacctagactgacgaagaaaaaaagaggactcaaccaaaatcagaaatgaaaatggagtcattgctattgaccttacagaaataaaaagaactttaagagaagattacgaataatttagataacctagatgaaatgaacaaataagtaaaaacacacaatttacctacactgattgaagatgaaattaaaaatctcaacaaacatataacaagtaaagagattgaatcagcaatcagaaacctcacaacaaagaaaagttcaagaccagatggcttcactggtgaattctagcacacattttaaagaaaaattaacatgaatcttcaaactcttctaagaagtaggcaaggaggaaacacttgttaactcattctatgagtccagcattactctaataccaaagtcagataaaatcgccacaagaaaagaaaatcacagaccaatatccctttgtagtgagtgcttgtaattgtatgttgtcttggcatccattttatatgtaagtttaactctctcatgccagaaacagggctcagtcacccttgacatagtctcatattcttcttcccacctgaatggtagccagaggtaaaacttagaggcatctctcctgcctagcagggaggactccctgctttcctgctacgtcctttaaagagaccattcagacatttgcctgcaaacttaaagtgatcacctctcagttacaaaatgaccacttgaaacgattgcctgctcactttaaaaccaccaattaaagccccccagtgggaagcctgtttagataacaccctagactgaataaaagcattggcccatgggtcccttctctctctctctgcctgtgcaccctgacctctacatgtgtgcagtctctgggcatgctgtgtaccctccagggtacataagtagtaaaaactcttaaactttcacgttgtggttgcgtcattaaagctgttcttgcaatctgacccctgacagtgaggcagccccaaagcgtacagatgtggattgcctctgctggtgctcttttgtccaagtctcttagctgctgggggacagtagttaacagctaggttgatagagtttcattcaaaacacccttatgaagatgtatttaaaaatccttgacaaaatattagcaaaccatatccaacagcacagtaaaaggattacacatcatgaccaattgagatttattccagaaatgcaaagatggttcaatataaggaaacaaattaaagtaatataccacattaatagaatgaaggagaaaaacacacgatcacctcaactgatgcagaaaaggcatttggcaaaattccaacatcctttaatgatttttaaaaacactcagaaaactagaaatagaagaacacttcctcaatatgataaagggaatttattaaaactcacaattaacaacatgatccaactataggccatctacaacaggcatactgaagggtgaaagattgaaagcttttccttctaagaagatcagaaataagacaatacctgccttcaccactgctatttggcattgtattggaagttttatccagagcaattagacaagaaaaataaatgaaaggcatccaaacttgaaaggaggaagtatatctttactcacaaatgacacagtcctacgtatagaaaaccccaaagaatccaaaagaaaattactagagctaataaattcagtgaagttgtagcatacaaaatgaacacacaaaaatcagttgtttctgtacacctgcaataaacaatttgacaagaaagttagaaaaaaagcacctccatttataatagtatgtaaaagaataaaatacctaaaaataagttaaccaaacatgtgaaagttttgtacactgaaaactacaaaacattgctgaaaaaatcaaagaagacctaaataaatggaaaaacatcccttattaagtcatgagtaggaagacaatatatttaaggtgtcaatactacccaaagttatctacagattcaatgcaatccctatcaaaattccaacagccttttttggcagaagtggaaaactcaatcctcaacttcatattaaattgcaaggggccctgaatagtcaaaataaccttgaaaatgaagaacaaagcggaaggactcacaattcctaacttcaaaacttaatacaaaaccacattatcaaaacagtgtcatactggcataaggataaatatgttgaccaatagaataaaattgatagttcagaaataaacccacacacctatggccagttgattttgacagggttggcaagtccatttaatgaggaaaaaccagtctcctcaagaaatagtgctgggactcagccgggcatggtggctcatgcctgtaatcccagcactttgggaggccgagttgggcagattacctgaagtcaggagttcgagaccaacctgaccaacatggtgaaaccccatctttactaaaaatacaaaaattagccgggcgtggtggcacatgcctgtaatcccagctactcggggggctgagggaagataattgcttgtgcctgggaggcggaggttgcagtgagccgagattgtgccactgcactccagcctggccaacagagcaagactctgtctcaaaaaaaaaaaaaaaaagaaaagaaaaaaaagaaatagtgctggcacaactgaatttccacatgcaaaacaatgaagttggacctctctcataccatatacaaaaattatctcaaaatgaatcaattacctaaatgtaagcgttaaaaccaaaaagctgctttttaaaatataggggtaaacgttcattaccttggatttggcaattgatccttggatatgaaaccaaagcataagaaacaaaagaaaaaataggtaaattaaactttatcaaaactaaaggccaagtgtggtggctcatgcctgtaatcccagcactttgggaggctgaggcaggcagatcccttgaggtcaggagtttcagaccagcctggccaacatggtaaaaccctgcccctactaaaaatacaaaaattagccaggcatgatggtgggtgcctgtaatcccagctactcaggaggctgaggtaggagaatcacttgaacctgggaggcagaggttgcagtgagccaagactgtgccactgcactccagcttgggtgaaagagtaagaccccatctcaaaaaagaaaaaaacaaacaaacaaaaaaagccacaaccctaaaaacttttatgcatcaaaggacattatgaagaaagtgaaaaaacaataaagaaaatatttgtaaatcatgtctgaggagggtttaatatccagaacatgtaaagaactacaattcaataaaatgacaaaatacccaattcaaaaatgggtaaagggcttgaagagatatttatccaaagaaaatatacaaatagccagtaagtacatgaaaagatgctcaatgtcattactcattaggggaatgtaaatcaaaaccacaatgatataccatttcacacctcctaagatggcaataattttaaaaatggaaaataagtgttgacacagatgtggagaaattggaactctcacacattgcttgtgacaaaatggtgcagatgctatggtaaacagtttggcagttcttcaaaatgctaaacgtgaaattatcttatgacccagcaattccacttcttagtatatatccaaaagaattaaaagcagggactcaaacctacttgtgtgtaaatattcattgcagcattattcataatagtcaaaaagatgagaacaatctgaagtgttcattaacagatgaataatgttttatacatacatacaatggaatatttttccaccatgaaaaggaaagaaattctgatacatgctacaacatggatgaaccttgaaaatattatgctataaaagaaatcagtcacaaaggacaaatattatacggttccacttacattaaatatcctaaatagagaaattcatagggacataaagtagattagaggttaccagaagtggcagggaggggaaaggaaaagttatctcttaatggttacagagttgttatttggtgtgattgaaaagttttggaaacagactggtaatggttgcacaatattgtgaatgcagttaatgccactgaatatagtttaaatatatatttatataaaacaaataacatgtgttataatacataatacacacacatatgtatataaaacaccacgatttaaaaacaataaaatgctttgggaaaatctacattaaagaaactacataactattcaacagtgctttccaaacttgtttgaccttggaagttttaaaaatggactacagttaacatttccaaggacatttatgaaagatagaaacaaagtacaagtgatcataattttgaaagggagaaagatggtctgcagtaacaagtcccccttgttaaagtgcagactgcttcagcagggctcagatggggcctgagatttggcatttccaacaaactcctaggtgatgctgatgctgctggtcctcagcccacagtttgagtagcaggggatataatagtactatatatgaagaatagcactattcttcatgatcctgttccctaccatagccaatttgatcaactgatctgaaagcaaagatgttaatggataataatcaataatttattatgtctccaatgtagcatagttataattttacatgggtttctaagacaaataccttattccaaagaagatactctgagaaagtgatatatagcaacaaagaagatcaatatgggatggggattgtcatacttggtgctgggggcagatgaggtggaattattttttcaaatacatttaaagtatgccagatctatatcttacttccatttatatttggattgcatacttgaattatggccaggccactctttctcataagaataagagaaaaaggaaaaatgagagcaagagagaaagggaaggggggagcaggaagaagagggaagaagggaaataggagacaaggaaggaacgaaggataggaatgatagtgccatgaaaaactagatgtttacataattcttttcaacagtcagattctcattcaactcatttttgaatatcatcactttgctgataaatcaattagatggggttaactagtgtaaaatatttccttctgtagtttacagagcacattcattcactggtgatcacatctaagaacatgtccctgtcaatcagaacacctgagcagactattgtgctaaatgcagatgaaaggttgtgctgacacatgctaggataactcctaaaagtggggaaaaaaacagttatctacaattcaacccaaagaacttgcaggtcaacttccatatttaggtagcttatatcactaggataattgtattggcctcaggcattttacccctgcagttaagaaaaatatccttaaagttaggcaatttctgcctcttataaactctgcgaccttgagaaaattaatgatctttatgcctcaatttttcttatctgagaaatggaggtgatgataattattgaagaatgaaataatacattcactggcacacagcaaggttcaaatatatgtcagttcttagtatatgcgtgtgctaatccctcatcaaaaaactttttttctttctaaggttttatatagaaatgcaaatgaaccttgaaccaaaaaaaagtgcccaaaattgaaaaagtcagatgtaaaggattaagaaaggtacaaaccaatgtaaaataccatggttagcaggccaggagggcaacaggatattatgaaatgagggaagtgcaacaaaaaggttgaaagtttaggtttttggaatcagaatgatgagacactgactctcagcttttctaattactgtgatgggacttcaagcaatttaacctctctaacaccatgttttctcatctgtaaacatttactagagcaataaacagattcgtcttttgtgaggattacactagataatttttacatgcacttagcacagtgcagcaatatatggtaacttaaaaattattttgacttccagcaacatactcataatgccacttatcaggaaagataaaaacgaatatataatggtatgacccagctttctaaatgcttccaagccagttgggtaggctagagaagcagaaaatgtacaagacaaccaatgtttaaattttcaaatttatgcttttaaatgacatttctctttttcctgtttatttttcccatcattcatttttctatctatcttgcatataagaattcaggaaagttttccaccttgaactggatgatctcgaaggaaatatttcattgtggagagaaagggaaaaagcaaacatatataatttcttgtgacttgcctctgccttgtctaatttatttctcattagcagaaaaatctttgttacaaaatagaattctatagccaagaaagagaaagtatctattttgctttgttttgagtaatcaaaaaagaaaaacaaaatccagcagagtagaaagtgaccatggagaagaattcatcatggcagatgctgacataagaggggccgggacaaattaaaaatagttggagcatttcaaagatgtctactgaaaattgttttggtaatatggtggtgcctgttattctgtgcctacaaatatattttttaaaatcacaatcacatttcaaaaggtagacttaaggagggctacaaggggccctctcaaatgaatgagttaaagaggtgaaagaagagaaaaacacattgatagtcctggtttgcatctatcaaaattcattagtaataagtatccaaactattttaaatataaatcctgttatacaaaagtgtgcataagaacacacttgtactttcattaggaaaagagagttctgaggggtataaggtgtttttcaagggtcacagaactcagtacatttcttttcacatccccactgcagaagattacacagatatgagcaaacacatgaaaaacaatcacaattactgtttcattaaaaatagaaaaattagttatgtttcaaagaataacaacacatctcttttaccacaactccttgctccttcttttaccaaaagattttgcctggggagttaaattagccattgtgccccaaatttcctcatttctagaaccccacacggacttctgaagaggtttaaaaatgcagtgtttaagtgctgccataacttgtgttttcactgccttcgagggaggcctcaagccaaattcctcttctttcagatcctacagatttgttgggtactgagccaactagggtgtttcttgcactgggctgctgatcctttgttgcatgaagacatacacatttctacaggagaaggcagcaagtaaatagatagttcatggcaatattagctcagaaagcattaggagaaaattccacaaaggcaataaatatcttccccagcaaaatgtgaagcagagaatcatcagacagtgatttacctactgacaaaaggtaagagaaaaagagaactgcagtcaggctagtcactggatctctggagataacaatggactcttattgtgtccaaagcacatctaggatgcaataatccttgctttacaccatatttactaaggtaacaatatggacgtaaattgacattactgtatgtgtttatgtcttaagttaattttgtttgttatatttctgtacatcatttctcattggtggtcagaggatataaagaaggagtggggtaaattcagaggtgtcaagaaaatcaaagtaacctgctgatttaaagaatgtcatacaaaaggaggtgggtgtttctgactcatccataactcaaaatgcagctccattttgacctcatgaccaggctatttcatcactacgagggaaccgctgttgatgtctacaatgttgatgatcctaaggtcaaaaataaaaaagccaccacccaaaaggctattttaatagaaacttatgacagtgaatccagttcaatagttttcagcttatattttccaaatccaaaactcttcagggtaagttgccattgcttaacagccattatccaaaatacaagtgggaatgttatcattatgcacctcagggtaaaactttttttttggcaatctcaccatcattttaattgtattcaaatctctagccaattgcacagatgttaatggagctgtatttttgcttcaatgtctattgcaatattctcattgcattctgcaggtcctccagtaaacgttacttgcaatatttttatcaacagttttggatcagtcacagaaacgaccatggtaagtgctgcaatgccactggcaagagaaagacacaactcaattatgctgtgaacacaaactgtcaaattttctattgttcaacttgcagggcctcctgtaaatgttacctgcaacatatttatcaacagctttgggtcaatagcagaaactacaatggtgagtgggactgagcattgaagccatcgtgtgaaggaatgggatgtgggattgaagtgcactgtggcatatttgtgagacatttactgagtgccaatttccaactttgctcgcctctgaaaagcaataatttatactactttattttgtaaagtcatttgtcaagtgttcattacttaatattcagtgatcttatatctatcgtgccagagaaatttttaaaacatttgatgttttaatggttttctgtagaattatccacaataaacatgatgcatagttatggatatttaaataggtgcatctccaatgcttcagaagtacaaatttcaaagtttgagagatgtaacagtatagccagttttttacatgtaatggaatttttaagatagttgagcctcccttcgatgccacattcaagatatattccaaagggctgaaattagaaaaatacacacacacacacaattttgttgacaagagaaagtagtcccaagtccataacaattataccatatgaatgccttttccaaaaaaaaaaacccctaaacttaaagctaattagaagctcattatacagtatgagtaaacatgtttcatatatctgaaaaagatttcagatactataaaatctaccagtgcattttttttttttttttgagatggagtctctctctgtcacccgggctggagtgcagtggcacgatctcggcttactgcaacctctggctcccaggttcaagcgattcttccacctcagcctcctgagtagctgggattacaggtgcacgccaccatgcccagctaacttttgtatttttgtagagacagggtttcactatcttggccaggctggtcttgaactcttgacctcaggtgatccacctgcctcggcctaccaaagtgctgggattacaggcgtgagccaccacaggatctcactcttctgcccaggttggagtgcagatcatggcacactgaaacttcaaactcctgggctcaaacgatattcctgcctcagcctcccaagtagctaggactacaggtgcacaccaccacatctggttaattaaaaaaaaattgtggagacaggatctcactatattgcccaggctggtctcaaattcctggcctcgagcaatcctcctgcctcagcctcccaaagcaccagcattaaaggcattaactactacacccaggcttctaccaacactcttcataaatgtcatggtcatgttacctgtgacatagcctattggatcattagtcttacccccacagggttctcggctacagcatggaggttgcattttgggtgagatattttcttggtccccatattatttactttaagtcctaaatcaattggctgggtctaatttgcattactatgtaaagtttacaaccattcatttgataaaaccaaaatcaagtgtaattgagtttgactaagtattatggtgcctgatgtcctaaaaataataagcataatgccattgagaagtaaaaaaaaaaaaaaaaggtttccttgtttatatgaattttctctttttggcaactaacatcatgtttaataaattactgttctttgtggtgtccttcatgttaggaagaattaatttacctttaccactttttttccactggcaaaattagacataattcaactccattacccattttgatattattctgaaacattattacccagaaatgagacttgtgaggctttgacaggatgtggtgcatttaaaaatttacctaaataggatagttttgatagggctattaaatgactcataataaaagctaaacacagaaagagtatatcaactcccaggttgacattcagtttctgtctctcccctcttggctttatcgtaataagagagggggcaaagcttccagtagcccaaatcactgtcaccagctttacacgatggcattcaatgacaatatttgcacgacctaatgctgattgcattaattagattcccatgttgctttgattaaatctcctcattgcatcgtattctcaatcaaaaatgtaaatgtgcaccttttcgatgttcattaatgcaaaaaaaagctaaacatttaaagagattaaaatggaagctatggatatccttgttttctgctatctttaacagctactgaaagtttaataaatgggctgctcaggtacttcctggccacttatttagtgacctttgtcatgcttcctgccagaaaatttggaaactgttgctcaagggtaacatacacagcctgtctattctgctgtataacacagattgaattgcatggttagaagactgatgtatattgtgcttcttttgttttacttcttagctttgatataatgacaaactccatttgctttaaaaatatattttgttttattcaattttggctttggtgcaaaactacagaaaatattttttggaactctatcatgcttgtcaaagaagaaatcctcaggccaccgagggtagggattggcaaactttttctgtaaaaggccagacagtatacctaagactttgagagccagatagtctctgtcacaactatgtgattctgcccttttggcatgaaagcagccataaacaatagtaagcaaataattgtggtggtgcaccaataaagctttacttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccaagataattgaggccctgcctgggactccacctggtacaccagtcttaattagctcaggctgtgataacaaaggattgattggttggcttataaacaacacaaatttatttctaacagttctggaggctggaagtgtgagatcagggtactagcatggtcaggttctgatgagaactctatttgggttacagactgctgacttcctctggtattctcgcatggtagaaagaaaattatctggggcagtaatccccttcatgagtgctctacccttacgacctcatcaccacccaaaggccccgcttctaccctccaatactatcacattggaggttagaatttcaacatatgaattttgagaggacacaaacattcagtccattgcacacccaaagtgtcatcacagcccaagctttctttaccataccgctaagattttaccatccatgaatttactgatagtttcacaaaatttgactcagaaaaattggtcaaaaaaattaaacagaaacagattcttccctgaactgtctttagttgtagtcagaatccttagctttatgcacagtgatgaggtcattgaggacattgattggtgctattttctggggtaatagttttgatttctctacattttctggaataaattatgtcaaagaatgcctcagaattttgagtttctaaacctgttgactttcctctcttcccttacacttcactctcaccccattatccaaatagcattattaaaagttttagtttggggtatttgttcccagatcaaaggcaatgattatatatttcaagaagtcaagatggctttctttgttgctatccagtctgcccttcctatggttaatgaagtcccactaatttattgtaggtgttgcctgcccacaaagtagaggcctgcttacagacccaataccaattctcactctgatatgttagtgtcagagatgtgtactcacaggacaacacatttgtgttactctaaggagtatttttatgtatcattatttttatggatatattattcaaaaatgcatttttgttcattaagacacacagaaatctgttagtgttcattgctagttgccccagcattaagagtattcagtggaacaaattttgtgtggtcccaaagacttagatgactaataaggagaaaatgataagataggttatattctgtttttgaaatgtgagtttaccgttttcttttatttttctcttttctttagtttctgacggcaagtgaatttacaggatggggagtatatttgcaacccctatttcctgatataaaggcatggtttgagaattttagtaatgtcagtaagggtcaagggtgctttcataccatctgtatatagctttcccataagtttgggccatcagaaaatagagaaaagatgctctcttcccagcttccaaatgactgcctggaaggatgtaggtagatagtgtgtgatttggacatatggatgctggaacactatccatgctacagcagtggatcctagtctgctccttatttaacagataggagggtgaactcaaagtgtacaaaatgtgtctgctcagagaacatctccagaatataattctagctccctcaaatccttccccacaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagctgcgtaaacaagttataagaagatgctgacttatcagggatagcaggtagctacatttcttatttttgacttcttaaggaagaatcaagaatctattacaagcctgacttttttttttttttaatggagtctccctctgttgcccaggctggagtgcagtggtgcaatctccactcaccgcaacctgcgcctcctgggttcaagcaattctcccacttcagcctcctgagtagctgggtctacaggcatgcaccagcacacctggctaatttttgtatttttagtagagacggtgtttcaccatgctggccaggctggtctcgaacacctgacctcaggtgatgcacccacttcagcctcccaaagtgctgggattacaggcatgagccacagcacctgggccaagtctgacattttttaaacaaacatataaggtgaccttggtctctaaattagcagtgcaatggtaaagcctcaatttatcataaagtaactgccccctataacttcaaactcaaggttagctttcccatattaaagctcgcacagacttgagattaggcctactttgggcactcttcccaagagctactgcctccaaaatgctctatgaacttgatcatcaggatgaatgtatttgaaaataagtcatgggaatttgtatagtttagtaaataggtaaaaaagaaaaacaaaaacaaaaaccgtattgaagcttttttccatacaccctaatctttacaacttaattatttttttcccttttgatcctgggggaattcacccaaacttgccatcctgaaatggtctccagagtagagtgactcccagtagagtgaccaactatcccaatttgcctaaactgaggaagttccctggatgtgagagttttggggccaaaattgggaagttctcaggcaaaccaggacaagttagtcaccattagagtaacgtaaacaatgaccaaaaatccagttgccaaatatgtggagatggagcaagtaagggtaaaaaatgtaaaggaaagagagtaataatgaattagtatatatcacacttgtggtcacacgtagcaatagtggataactactagctctgaaaccacagactggcttggttagggaatactgttgaagcctcaatcggagtccagattatcaagtgaagtagtactttcaatgaacctaaggtctttgagtagaagtccccagaagagcagtcactgcccccaagctattcattaacagaagaaaattcccagaccaaatgggaatgccaggggtgtacctaagtctcccacagtgttctgattgagaacgtgaaacatctctggataaagcatcaagttggctagtgtagatacaacacattcagacaaaatgataagaatttcaaaagtaagtagctgcaaggaaaatattttgtcaacatgaaagatcttaatgtttacgttgataaattttaaaatattgccccatcatgtcatagttttataagattttcactactcaaattacgcagtgggtttccttctgcccagagcatctcagcagaaagggatcagagatcatgtgatttctgatttggaaaataaatcagttttatttgacaatctgccatgacagactgatttctgtgttcattgtttacctttttctgtagcaaaatcagctttagtattatttcatcccaaaatgaataatttaaacactaaaaaattcaaccaagtcaacccgttttattggtgttctggtttggttgaatcttcctttttctttctcccttttgtcccctctcctaatagaactaaatggtttattttgaccaaggtatacacagtttggtttactcggacaccaaagctgtatcaaatcagggagaagaatgagagagaaatgcaaatagaactcctgtgccagggtaatcagtaacacttgtccacggcatttctgtaggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcaggtaagcctccattggctgcacatgttcgcatctccatttctccactaatgtagagctgcctgattctgcagggtaggatgtatatgaatatttgacttttgtggtttcttgtttatcatttgaatcttaaagttggtggagagtgtcagaagtccctttggtctcataaatgtgattctccataacaagaatgtatttggtaggatggtacatggttaatggtattgtgtaatcacctgcacaaatgtgttcctgattgcttcagtaaaggaagtacaggctattccgttcaattgccattaagcataatatacaaaatctcatttcaataattctgccattctgtaacattcaagcatgcacacacacacacacacacacacacacacacacacacacaaattcaatagctcagcatagtcattaacaacatacttatagctggatacatggaaacctggttccaatgtcagctttgcttctaagtaaacacgtgaccttgatctcttaacttttcttggacttgggcctgggacagacaattgctgagatccatttttgcttttatattcaaatatgatcttctccagaagtgttatcactctaggctcaaaataatctcccccttttctgaactcatatagcagtttctttttttttttccatatttttttattatactttaagttttagggtacatgtgcacaacgtgcaggttagttacatatgtatacatgtgccatgctggtgcactgcacccactaactcgtcatctagtattaggtatatctcccaatgctatccctccccctccccacccccacaacagtccccagagtgtgatgttccccttcctgtgtccatgtgttctcgttgtttaattcccacctatgagtgagaatatgcggtgtttggttttttcttcttgcgatagtttactgagaatgatgatttccaatttcatccatgtccctacagaggacgtgaactcatcattttttatggctgcatagtattccatggtgtatatgtgccacattttcttaatccagtctatcattgttggacatttgggttggttccaagtctttgctatctaatagcagtttatctgtgactctgtaaggctcttattttttcctgccttattattttggttattgctgttcatgagtatagcataaaaacatggatttctggaattagacaaatctagaatcaaatcgaagctttgccacttactaagttatgtaatctatgaccctcagttaccttaattttaaaacgggaaactccatgtttatctctgtatattcttgtgtgaatgagtaatgtagtggtcagcaaatattttctgtaaagggccagatattatcttaaatgttgcagaccagattgcctctgttgcaactactcaactctatcattatagctcaaaagcagccataggtaatatgcaaacaattggacacggctgtgtctcaataaaatattatttacaaaaatagatggtggactggatttggccctttggctgtagtttgccaacccttgatataagatatattaaaaatacttgctgcagtgcctgacacagagtaaatgtttgataaataaaataatggctatctgtattttaaaatcagttctttttttttaatgctcaacatctctaatcattagaaaaatgcaaataaaaaccacaatgagacaccatctcacaccagtcagaatggctattattaaaaagtcaaaaaataacacatgctggtgaggtcacagagaaaacggaacacttatacactgctggtgggaatgtaaattagttcagccattgtggaaagcagtttggcaatttctcaaacaaagcagaattaccatttgaacaggcaatcccattattggatatatacccaaaggaatataaatcattctaccataaagacacatgcacgtgtatgtatgctcattgcagcactattcacaatagcaaagacacagaatcaacctaaatgtccatcagtggtagactagataaagaaaatgtggcggctgggcgccgtgggtcacgcctgtaatcccagcactttgggaggccgaaatgggtggatcacgaggtcaggagttcaagaccagcctggccaatatggtgaaaccccgtctctactaaaaaatataaaaaattagccgggcatggtggtacgtgcctgtagtcccaactactcaggaggctaaggcaggagaatcgcttgaacctgggaggcggaggttgcagtgagccgagatagtgccactgcactccagcctgggtgacagagtgagactctgtgtcaacaaacaaaaacaaaaacaaaaaaccaaacaaaacaaaaactggcactgtacaccatggaatactacacagacataaaaaagaatgagatcatatcctttgcagcaacatggttggaactggagggcattatcctaagtgaactaacacaggaacagaagaatactgttcagtgaatagtatagaatagtacagtactgttcaactgaacatgcagtacaaacgctgcatgttcttacttataagtgggaactaagcattgaatatatatggacacaaagaagggaacaacagacactgggacctacttgagggtggagggaaagaggaggacgagaatcaaaaaactgccttatagggtactacgcttattgcctgggtggtgaaataatctgtacaccaaaccccgatgacatgcaatttacctatacaagaaacctgcacatgtatccctgaacctaaaatcagcgtttagaaaaattaatgttccttttcagtagtaagctcttagctctttcaattcaagatatttggtttttgtcttttttgtaacatctaccaaatgtctaggacaatgtactgtatatgagagacagtacattgaataaagtattggcatttaaaggtccttaacagaatgccccctttcgctatataaatttattaccaaaaaagtaaacagctagtctccttgcaaataatttttccaagtctgcagactcaccatcatcacctcatttgacaactctgtatatgatttggttctgtattgtaaattccattcttatacctagtaatttcacagcatgctgatggctgacagccccaatgtcttgtggaataaaagaagctgctcatttgtaaaaagcggcaaagtcactgcttgcacagaaaaccaggaaacttcccccagtgaccattcatttttaaggaaacacaaaacattctccatggtgatgtgtttggttggtgtaaaatgcagtactgagcacaacataaattgatcggacctgagaaaatgggacatatgtggagtgtggtgctaggaaggagagttataaaaagcagcacagagcatcagctgccccagctaatcctccaggccttgggtggcatttgctctaatgaataccaggcatcacacactgctgaaataaaatcagattgtagttgctgttgttgctttcttgctgttttgtgaaggtctttacattctagaatcatgaagagtatgatgctcccaagcctagacccagaggcaattcttgtgtctctggttcccaagcatagcacattacaggccctgaaatgccctgacaactgttttggattaggtggggattgtcctgtgcaggctattttatacttttctttcattgtgagtattttctgaaatcaaaataaaaaaccttggtaaaggagaattggggatatcattttaagaaaatacaagctgttcggagatttgaactgcaagaatctaattatttgcctagaagggcttttgatgaaccagatactgtactgggtctagagatccagaactaagtaagatgtggtctttcccctggaatgacttcagtctaacaaggcaggtggatgcatgataaattaagtaataggaataaataggaaacaaggaaaacaaaagtggctctaattttgcaaatgaagtatgtgatcaaaatattgtcagaatttggcagttggcatccacagtcctgtttgtcagtgggctcaatttaactagaggtcaaggagtaactaatgctaatatatgcccagctgcaggtttgactcaaatttaaggccaaggggggtacagttgtgtccatgtcttaaaggtgctgaaaagttcctgctgacgttccattagaaagtaatttccctgcatactcaggtttacaacacaaatactcccaggagaggaaatccactggcttaaatccatactaaactctaaagagctgatataaaatttatttctgaggatgaacatactggattcctaagaggagaaatgggatagaatgaagaaaggttgggaaagatacaaggaaggggctagaagtaccaaataaaaaccctaaaactgtctccacatacacagtaaatacttaagcaattatttaattatgtaagcatgtggtccacattttaaaaagtaatgttctgtcttgatactctgtatttgcattttcctgaaacctaaagcaaatatcaattgcatttaatctgggaaaaattccatgcttttcttggctttgtaggtgtaggggtagaattaactctatatgggcaccaaagcccaaggttttgattgtcaaacaaaacaaatatagaaatatacagtccactgatttcataacaagcacgatcacctttcctaatacttcatatatctgtattccaaaaggtaggggtctaaaaaaaaagagaaggcagtagaccagaactccgtaagtgtcatccttatgaacacttggggtaccttgactaaaattcaaacaaatcttttaaataggaaggaaaggccttatctcagtgttaataaaccttttatccagtgatgtaggacacaatctttgttgatgaaaaagtaccaaatccatttctgtccatttttctttaatattcattctctaatgttttatcttactctctgttttttcctaagttgtttgttgacctgccccattaattattgatcatctctgacaagagtatacattttgatttgtaaaccttcttcagagaaagtcaataatccagagaatagagatcaagtactgagtaacatgtggtccttcatctgggatggggaaagagtcaaattctaaattcagagagagtcaaattctaaattcacattacttacaatgaatccatacttgaatccatactgaaatagtgaggtgagtcttgaaggttgtacatattattgtttaaacaatatttgttgaatttaatattgtgagttggaataaaggtcaggacatcatgggatatggtggacaacatgaaagaaaaaaggagaaggtgagcatttttgaagaacagctcatctcacatgcccacagtatctttgctgatattgtcttctttttaaaaatcccattgcttctgagaatttagtcagaaatatgacttttatagaaggattttttttaaatttgaagttaccttgtaaaatatctaatccaacacccttgttttgttgataaggacgtcacaatggagctagtaagtaggaaagctaggacaagaatcagggctcttaacttctgtttcagtgctgtcatttcctacccccacattaattcctcatttacttcaacccaagtccaaagacacaaacacacacaattcatgttgcagcaaagggcatcatttcatgcttttttatggctgcgtagtattctatggtatatatgtatcacattttctttaatctaccattgatgggcagctaggctggttccatgtctgctattgtggatagtgctgtgatgaacatacaatttcatgtgtcttttgtagaacaatttattttctttggggtacacacccaggaatgggattgctggttcgaatagtatctctgttgtaagttatttgagacgtctccaaactactttccacagtgcctgaactgatttacattcccaccaacagtttgtgtttgcttttctctgcagccttgcagtatctgttgctttttgactttttgataatagccattctgactggtgtgagatggtatctcattgtggttttgatttgcatttctctaatgaccagtgatgatgaacattttctcctatgtttgttgaccatgtgtatgtcttcttttgagaagtgtctgttcatgtcctttgcccatttttaatggggctatttgttttttgcttattgattggcttaagttccctatagattctggatattaggcttttatcagatgcatagtttgtgaacattttcttctattctgtaacttgtctgtttactctattgataatttcttttgctgtgaagaagctctttggtttaattaagtcccatttggcaacttttgtttttgttataattgcttttggggacttgtctaaaaataattttccaaggccagtgtcaagaatggtgtttcctagcttctgtctaggatttttttttttttttcttttgagacaacatctcactctgtcacccaggctggagtgcagtggtgtgatcttggctcactgacaactccattcctgggttcaagtgattttcttgcctcagcctgccaagtagcttggattatatgtgcatgccaccatgcccaactaatttttgtagttttagtagagacagggtttctccatgttggccaggctggtctcgaactcccgacaagtgatctgcccacctcagcctcccaaagtgttgggattacaggcatgagccactatgctcagccctgtctaggatttttatagtttgaggccatacacttaaatctttaatccatctagatttaatttttgtatatagtaaaaggtggtagtccagtttcattcttctgcatatggctagctagtcattccagcaccattttttgggaaaaggagtcctttccccagcttgttttgtcaaagatcagctggttgtgtgtggctttatttctgggttctctattctgttccattggtctatgtgtctgtttttgtaccagtaccatgttgtttttattactgtagccttatagtacagtttgaacttgggtagtgtgatgcctccagctttcttctttttgcttaggattgctttggttatctgggctgttttttggttctgtatgaattttagaatagtttttttttctaattgtgtgaaaaatgacattgttagtttgataggaatagcattgaatctgtaaattgctttgggcagtatgactattttaatgatattcttcaaatgtatgagcatgggttgtttttccatttagttgtgtcgtctctgatttccttcagcagtgttttgtagttcttgtagagatctttctcctccttggttagctgtattcctaagtatttcattttttttgtagttattgcaaatggtattgtgttcttaattttactctcagctggaatgttattggtgtatagaaatgctactgatttttgtacattgattttgtgtcctaaaattgtactaaagtcatttatcaatttaggagccttttggctgagtctttagggttttctaggtatagaatcatatcattagctaagagaaatagtttcagttcctctcttcctatttagatgccttttatttctttctcttgcctgattgctctggctaggacttccagtattatgtttaataggagtggtgacagaggacatccttgtcttgttccagttctcaaggggaatgcttccagcttttgccatccagtataacgttgactgtgggtttgtcatagattgctcttattattttgagcgatgttcctttgattcctagtctgttgatggttgttaccatgaaaggattttgaattttatcaaaagatttttctgtgtctattgggatgatcatatggttttgcttgaaccttcctcaaaatatatgcatattttggcagggcgcggtggctcatgcctgtaatcccagcactttgggaggccgagatgggtggatcatgaggtcaggagatcgagaccatcctggccaaaatggtgaaaccccatctgtactaaaaaaaaaaaaaaaaagtacaaaaattagccgggcatggtgtcgggtgcctgtagtcccagctactcaggaggctgagacaggagaatcactggaactcaggaggcggaggctgcagtgagcagagattgtgccactgcactccagcctgggcaacagagcgagactctatctcaaaaaaatatatatatatatatgtatagtgtatatatatacacacatatatgtgtgtgtatatatatgtgtatatatatgtgtgtatatatgtatatatatgtatatatatatgcatattttgtgcattaggttatttaagctattttttgtttgtttgtttagaggaaaaggtccttatctttattaaagaagctatgaccctccaactgttaagagcttgagctttgtttccagatttactgcatgcctccagaatgggtatgcctaaaggtgaagtgattaaggaaatattgtttgctttcagtgtgttattaaactgaccagttatctgggggcctcatactaccatctaataacccataaataattataaaattgcccctcaacaatagcaccccatatcaccaaagcatctgtttacctcatcatcaacctttatctgacctaaaacttattggcacctaaaactttatggcattggaggtgatttgcttgttaatcccttttgattctatttgcaattctgggtgttgataattcagtattctgccttcccagtagtacttgagttgtaatagagaactcttggggattgacacgcttttccctctgatgatagattacaggcaccactgagagtaggtatagtgcagatttctagacagacatccaacgatgttcctccaaacaatcttgtctaatgaccaactctacccacatacataaaaggctagcttttctcacatggcctcccatccttgactcatcctatagtctgatgcaagaacttcaaaagattctaactttagttatatatttttttatggcatagggaataaggacattctctatttagatgtcagagccaaaaataaaatgtacaatgaactgagacctgccttaaatgttgccagtggtgttgctttgattaccttactctcaattttgatgagacacataagcccgtattttctattagaaggcagctatgaaaaactatgatttcttttcgctgtgcatatttggaccattatttatctttatgttctataatccaggcaaaattacattctcattttctaactctgtgtccaaatcctcattagtattgtgacttaagtaattaatgtctgtaacataagcgtccacatcagaattaagcagtcttcagagaagtgctgggaaatgccatggaaaccacaatgattccattcttcctagaggcgagcaaggtcgggagggtgggaagcactggcatgcacatatgctagtggattcagcaggagctgtggtgtggaggggctgtttttggagaggggctctttaaaaaggtacagctgagggtagaaatatgaaggtccagaaagtgcgttgtatgtatgacagactctcataaagtatggaaagctttgttgagctcctgctcaggttagaaatacgcaaacactatgggacctaatattggttcagacacaacagagtaaggatcttgtattagtcagggttccctagagggacagaactacaagttacatattacatatatttatgaaagggagtttattaaggagaactgactgactcacaccatcacaagatagagtcccatgataggctgtctgcaagttgaggaacaaggaagccagtggtggatcagtctgagtcccaaaacctcaaaagtacggaagccgacagtgcagcctttagcctgtggccaaaggcccaagagcccctggcaaaccactggtgtgagcccaagagtccagaagctgaagacttggagtctgatgttcgaaggcaggaaacatctagcacaggagaaagatgaagaccggaagactcagcaagttggctcttccatcttctcctgcctgctttattctagccgtgctggcagctgattagatgatgtgcctagccagattgagggtgggtctgcctctcccagtccactgactcaaatgttaatctcttttggcaacaccctcatagacatacccaggaacaatactttgcatccttcaatccaatcaagttgacactcaatattaaccattacagatcttatgcttgtttggaggaaaggagagacttgatcaatgaaatacatggcagctagcatgaccacttgtccttaactgtttacgtgactggactagcaatagcaaccagtaggttttcttccatttagaggtaaccttacatttcattaacattcatcagtttgctcttcaggcaatggtacaaagaacagaatattgagaagatggctcagggcattgtgatctccacacttcctttcatcatttactgtatctcccaggatcatagaacagcctttccagctccataagtttatcattctgggtctcagtttcctctataaaatgagactgaaccagacacttagaccaagtatgaggctccttctagcactattataagtctgtaactcaaaataacgtccctctccttcccaaaccacaaaacactttcctgatgagtaaataagagtgcattcttcatgtcccttagggcttgagtcagcagaggagattcagaatttcaaggtgcctgtcttaaactacttggatctttgaacccttttctcctgaattaaatatacaactcctgagaagaggaacctgattttggagtaggttagggaggtttggactacctgtaatttaagaggcagcgttaaaacattcaacatggccgggcagagtggctcacacctgcaatcttagcacttgggaggctgaggagggtgtatcactttagctcaggagttcaagacaagcctgagcaacatggcaaaaccccatccctacaaaaaatacaaaaaaactagctgggcttggtggcgtgtgtttgtagtcccagctacttagggggctgaggcaggaggatagcttgagcccaggaagtcgaggctgtagtgagccaagatcatgccactgcactccggccttgatgacaaagtgagactctgtctcaaaaaaagaaaaattcaacatatagtttacacaatgacaaatactcagtatcaagtgccctgagaaacttcccagtcgtaaactagatcatttgtaccctctgattcaatcaccaggaatatctgtgaactattattttagaatatgttcatgaaacataggtttatatacttttagacaattacacaaagatggttggctgggaaaataattgactgaatatgtagactaaaggaatcatgtggtagatttgagccagcagagttgaagagctagtctgctattattactcatcacctgaactttctcatggcagaaagccaaaggaaaaccagaggttctggtgagggtgctcaacttacattaatgtgggcttctacctggtccacactgctgctttgaaaggctccctggatgacattaataccaaaataaacatgcataatgtcaccatggctcttatgaaacatatgaattactttagttcattctcacagcacataatccaaaggaaaaggtactttattttaaaatggaaaaaaaaatgtgtccatctgcgtatctcagcagtctctccaacaagtttcttctcgcttgtggtgtttaaaattacaaaccaacatctgtatcaaagaggatacgatatttatcattggacagtcattaaaagattattaagtacgtatattaatacaattatgtgaagttccacatgagatatactctcagagcaaagccatctcatttctgattgattggttatttcaaatgacaataaaataaaggttttatttgatgtttcattttagtatggatattttgctaaacttgagcagtcagatgaaggatagaaagcaaaaagtatgctaggggattaaagacagaattctattggggtgggacaaatgtcagttctgagggtcaggaatacttggattcaaatccaattttactaaatgaccataaaaagtcatttaacctttctttgacctgcagtttttctcagttccagattcacaataaatgttcaatgaatgtcttaattatccctgagttggctgtaggataaaagggaggaagtaagggcgacaacgccccttaccttccttaacacatacgtatggacatacttgtaccattcaggctccactcactttccacacttagtccaaagcagatggatactctccttgccttgagtttcctctttttgggagacatgtagctcataacagaggtgacagttgcatctactttcagataatagtttagctgatgctgttcctcccctttagctgcttgttaaaagtaaactgaggaattatgcttggtttcaaagtgttatccagtcaaggatggaccatcctatcaactgaccagaactccattctctctccaaactttgccaccagaaacagtggtcagtaagtctccatcagttaccacagtggaagtctttttaacgcagcaaaatatcagccaggtaacacaattttgccctcagttgtcaacaggtacaaggttactttggttttctcaaaacggtatctgcagttcataagcatgcttacacgtgttctcttcccccttttttttaaagtaaaatgaactcaaaacattttaaaaattgctacactgtacagtaactttctccctttcttcacctcagtgccacgattaaatagctgtaatactagacgcatagtaacaatgaaaaaggcagttctcattatttcaatgtgcaggctacattttaccttcaccaatgttttgatatataaatactagatgtgaaatgactttgaaatgtaaaatgtaactaagatgtgggggagtattgattatttaaatctttggtaatttgagttccttcctctgatggtgttcaatttatccctcttctattcaacaccttcaaaacattttcatccaggaaatatcaaagcatttgggaaaattttagctgcagatttatcagttgctctccaagttgaatccaatccacatttggacttaattaacatgggccaaccatatgtgtgcacactttctgaaaggaccacacacagatgggaacagatattgtatttttgtccttcccagctactattgctcagtgcatatgggtattttttatgatgcctttataatatttggtaaacatggaccttcctactcagccactgggattttagtcaggggagaggagaatagctaatgagccaagcagtgttgccatttatctcctctacatcccaaggtcaacaggaaaaaaaaaaaaaaaaaaaacagcaaaagtgcttatttggaattaatagagaggaaagagtctaaccatacagcttagaaacaacctgggatttaggtccagccttagacaatattgaaaaaatgatgtgtctctggtgcccagccacactgttctgagccctgtttttcatctagtttcatctttccctttgattttcttagtatgacagtctgcccttggagatatcaatagggaatctgggaatctatcaatttatttacacaaagaaggaaatgagtaacagtacttgaaacacatttctcttcctagctttgcatcttaatagtcaaagaagcctttagctaaatgtgtatttatttattatatatagcagctaagagttggaaggtgtttgagcaaggatatattgggacctttgtggaactcccaacaatttatacaccattaatttttcaaactttgattaggtggaaagtcttcccaggtgccaagctcagggctggagtaggcaggactctctctatgcattacatgatgtaagttcaaagtagccatttaatcacagagctttcagaaatggtaagttaaaaaatttcattccttgcctgcctaaccagacttggaccaattccttttgttttctgtgaataaagatcctcatgtgggtacctcaggttcaattcaggagcatcaagtcatgcttctctgatagaccaaaagggccctctaaggatccaggtatgtaagaatagataacctgctctacccgatcactgtgagtgcttatctgggccccaagggagtaattaaaggtcctttacttgattctgttcacgtgtgtctgattcacatcatcaaaagtattgtctaagtgggagagttggaaacaacttcgaaaagttcaataataaattgaaactattaggatacatatctgcaattctgatattaagttgtgatctccttcaagagacacactgtcttattttaagtgtctggtgcctggtgcccaataaatatttgccaaaatattgctgaatggatgtataatactaagttacagcccagatgcagtcctgcttaacaccaatccctccacaataggacctagagctagtcttcccatgtactctgttctttatgaccagtaccatgagatttcctaaaatttttgttgtggttcattcaatgcaggttgcagccacctccctaacttcttttgaaatttcttggtggcctattttccagacatcagagacagtaatctgatatgctgccatcgccctgagtagagttcactgcctacttttggcctttgcacactggcatgtgttaaaaggcatgatggtcttggcttcttctctatcttacctagaaactgtcctcctaaccctcttagcagctctcccagtttcctagccacatctaccatattcttggttgccagtggactgattttggcttcactgccctgacttaaccagtatacctctccaatgtgactgaagcccatgattaacacccccaacttgtatcattacccctagtccaatcacttagcagcctacttgaggctaactgtcctaccctaatgtcgagaggctgagggaggagaatcgcttgaactcgggaggtggaggttgctgtgagccgagatcatgccactgcactccagcctgggtgacagagcgagactctgtctcaaaaagaaaataataataatatttcccaaaggagtgctactgttactgaaaaattatagacctctttcttaaaaccttctcctttttgtctatcacattgacagaaatcaaagtcatccctcgggatatgctgaagtagtactccttaaagtgtgctccaggaaaccagcattggtgtaacctgggctgctttatcaagagggcctgataatctgcattctaaccaagcccataagacaatgcttatgcccaccagagactgaaacccactatactaaaagatggttgatcagacaaccagcctagcggtgttttttatcccagtgatttcctaatcttccctccctctctccatgtgtgggctgtattaatgatgcacttttaacttgacttctaacttgcccccaggctaatttcacttaaggtctaggtgggttaagatgacactcttgtttgatacttgatgcatcctgtcaaatctccctgacactagaatgtcacatggttcagaaatttcaaggtacaactgggaggaaagattcaacggatcaacatggtacaggaaggccttccttatgttctcagtgaaagagtgaatagtgttctaggatgttggatgacaaagccctatggaagcaataaatgtctcacctatctgcccagattgccaagaagttcctattttaagaagtgttacttgcacttaaagttttcatcatattcaagagggtaaatttacctataagaggaaatccttcaagctggttgccttcacttatagtttataatcacagagatgttgagcaggatggggatgtttgctgggggaggcccagagatttagtcaagatcaaatagctctttatgggtaagccaggtctatcacccaggtttctgggttgccgggagaggctggaggagtttttaaaacaacaagccatgaggattctgggtgtctgaggaaaaatgaaaggggtatccctgagcaggtacaaggcaactaaggtgtctatgaccaactctgctggcttcatagacaaaagaggataataaattggtaacagattattttcctaaggaggaaatgtgaaatgtgatagagtgggaaataataaagggaatttgatgtcggttaaagctgtattcaaatctaacttcggttgcttagtggttttatgactttgggaacaaagcttaaactctgtgagtttcaatttgcttatctcacaaatggaggtaacactgtctgccttgtgtgataatactcagtgattataaaataataagaatgcttgacccacagcaggtgttctgagaattatgattattaatactattatcaccatcactttaatttttagtttgcctaagtattttcatcctaaaggagcaccataggttccagcccccagatgtgtccatgtgccactgaaagtttgtggtgtgctgcataaagagagataaatgtggtcccaacagaggaacagcaatacccccaagactctcttgttcgtcctgaaagacacagaaacatcctcttgtccttcctctctgaacaagagaaactattgtaatcattagaattaactctccaaaaatagcatgttgtcaatccttgctttagggaagcagatcactcattaaaatttgtatttgtacctgaaaattcatcttctcttcaaatggtatttttccctcaagagtttcattgggaatgaactccgagttctaattctaagttccttatgaaccagtagttgctttatgagtcaagcagccttctgtctgccataacattgtaatgttaaatgattaatttacattcttctagcaatgtgaaaatagccccagccatggccctaactagttgaccaaggttccaggacaagtcagccaggcttcctggcattcctttaacttgatttgttttatttctagtgagaatctgccagcaacttagcggaggcaccaggcaagctttgacagtcctgtaatttagcagcatcctgtggactctgatgactggcctcgtcccttctaaatcctttaacctttcccatttccacagaataaaagcctgaaattctcacacaaattttaggatactgattcattaatttgttcaataaatatttcttggatacctactctggtctaagcagagacaggggttcagccttcataaatcttgcattgtagtagggaagaaaaataaataaaaaatataaaaattacaatatttgatttaacaactgtaaaggtaactgaaatagtttacagtgtctgcatctatcagtcatttaaattttaagtgaggtataaacccaagagatggttttatgagcaaggtgaactcaataggaaagtagtaagaaagggaaagggcaggaaaggtgagattttgggagacggactttctttgctttgttctattctttgcctttaaaataggaatgcttgctcagccttcttactttcagtaaagaagcagggcctctgtgaaggaactttacttcttcccttgtgcaaacaggagcaggggtgccctgaatgcacagtggaggaacggacaataatgcttcaggaaatgagttatttaacaaaaatcaaaaggaagaggggcagcctcagctcaatgccttcatgtgcaatggccttaatatttcagattatcggggaagaggacaaatctgacatgctggtcaatgtctgccagtgagaagtctgagtgtccaggcaagttcggaagactactggcttcccgactaaaatagttaattctgtgagacccacccaaagtgggtgaaaagccagagcaaaggagataaaaattgttcacattttagtatattggtgtatagacatatcagccttatttggtgcaatttctgcatgtctgtacaaaataatatcaagttctttttttcccccaaactcatatttaaaaaatcataaaatagcctttttaaatagcaaatggggtggcacttttgtagattcttgtctgggagcataatgaaatattctagggtgatgggaatgctctaaatctggatctgaaagcttgttaaataggtgaatacagatgtaaaaagtaattgcactgtatcttaagatttgtgtttttttactgtatttaatgtacacttcagtagaaaaaatgaaaaaggaaaaaataagtagcgggaaaaacctagatcttaggcctttagatgcacggtagactggatgtcataaatgatgagctctgaggctcaggcagggacttattagatctttacaatatctttctatttgctcatgatttaacaaactgcggaactgttaactctcctccttattattggcacccactgggttccagtacaaaacctatctagaaaggaaattagaaaaacaaagaagaaaaaaaaacccactgagttctcagctgagacaagattcagggatagggtcatgcttgttaggtatttctctcagtggggtctcccatgctgttaatagttttggctcccaaaatgctgagcccctctaggatagttagatctgccacaaaggcagcaataattgtgtgtgagatctctgcttcctgaagaaatgtgaaaaggtcattttgcaaaacagtcaaattcagcaagcctatgattaggaatattaaagttgggttgtttccagtaacaaaccaatatatagttgaattctgtgacattcttaaaagaacatgttcttttaagctgtgttcatcttcattattattatttttaatttctttaaacttttcaaaactataatgaaatttccagattttttggttttgattcactgaaaccaattatccatatgccatctaattattttcatataatgaacatttttttaatttaaattttaattttttgaattgtaaatggacaaattatagttgtttatgtttatggggcacaaagtgatgttatgatttaagaatagaatgtggagttattaaatcaagcaaattagcatatccattccctcaaatacttattatttttttatggtaagaacacttgaaatttactctcttagcaattctgaaatatacaatgcattattatttactattttcaccaagctatgcaatatatctccatgaaagaaaaatttattccttctgtctaattgaggctttgtttccttttgcagcactattcataatagacaagttatgaatgaacatatttttgtatgatgaaaatatttatttcttctttgaaaaatagaaaaaaaatagattctcattatggtaataataattttaagctcatggatccttttgaatttttttcacctttaataaggtgtcagctttgttgttgtttttttttttgtttgtttgtttacttttttttggttcttatattctgtccttatttcaaagagttcatggcattaatctacacaaaattgtgttttcaaaaaaacaaagtctttatgctgggaaccaaaaactaaatatctgtatatctatagctatatctgtaaatgaactccataattgacaacaatttttcctgcctaaaatgttatttttaagtcagttgtttagaactataagccacattttttcctttagagacatgtttgggttctcagaatagcccacggaaggtagctaatttatttagcaatgaatgtgaaatgctgtaggtttgtggcaaatttttaataatcatgatatgattgtaatagcaaaaaattactgaacgaaatggaattttgtaattttacctttcagttattgtttgaagaaaggcacagctaattacacaaagatgggaaagctgttatatgaatagtttttatggacattttcaaataatttatactgctcaattcagataatgcaagataaagaataaaaacaaaatatgaatcatcccactaaccaaaaatataatggtgtgcttatttccaagatttaaaacatgtttttacattgcactgttttatatctttctttttccagtcattatattttaataattttgatgattgtcagcgtggattctttgtctaatctgacttcaaatcgcaaccctttcctttctttaaaatacatgtgctaaattttgttttgtttgcttttacttgaatagattgtaaaaatgaagcagagaaaggaaaaataaaggaagcaggaaggcagagcaagaatgagcatgacagcaagggagagtttaggcaacagtgtgagaattcgaggggtctttggatataaaaggtgtttgagatacgatgaacagaatttgaagcagtcaactttagaaaaatacggattgtagtattaggatcaaatgagaataagcatcatcttacctacctcatcatttggttgatgacaaaacaaatgtttagcaagtttaaggtcttgtttgggggaagagatagtttgaggcagtactaggaagggaaccaagacttactaattctcaatcctaatttccttccttgaatcttggagatacagaaaaatgggagagcaagaggtgtgcatcattcccttaaggattaaaaagggaaatggtggaaatgagatggtagctcaacgaatatcctgatataaggatcagccagagctgactggagttcaaaaaagttaaggaaagaggaaagtggagcagagtaaccccttctgggtgcagagagctgaagactatgtacaaaccgttgtttgtttgtttgtttgtttgtttgtttgtttgttttgtaagataatgagtagtttgtttttcctttttttttcaatttttttatttccataggtttttgggaaaaaggtcccatttggttacatgacttaagttctttagtggtgatttgtgagattttggtgcacccagcacctgagcagtatacactgaacccaatttgtaatcttttatccctcacctccttcccaccctttccccttgagtccccgaagtccactgtgtcattcttatgcctttgcatcctcatagcttagctcccacttatgagtgagaacatgtgatatttggttttccattcctgagttacctcacttagaataatggtctccagtcccatccaggttgctgtgaatgccattaattcattcctttttatggctgagtagtattctatcacatatatgtaccacagtttcgttatccacttgttgattaatgggcatttgggttggttccacatttttgcaactgtgaattgtactgctataaacgtgtgtgcaagtatctttttcatataataacttctttttctctgggtagatacccagtagtgggatcgctggaacaaataatagttctacttttctttctttaagggatctccacattgttttccatagtggttgtactagtttacattccctgtagaaaggttcccttttcaccacatccatgccaacatctattttttttttttttgacttttttgattacggtcattattgcaggagtaaggtggtatcgcattgtggttttgatttgcattaccctgatcattagtgatgttgagcattttttcacatcttttttggccatttgtatatcttcttttgagaattgtctattcatgtccatagcccactttttgatgggattgtttggttttttcttgctaatttgtttgagtttattgtagattctggacattagtcctttgtcagatgtgtagattgtgaagattttctcccactctgtgggttgtctgtttactctgctgactgttccttttgccatgcaaaataaacaaaaacataaagtaggggaaggacaccctattcaacaaatggtgctgggataattggcaagccacatgtaggagaatgaaactggatcctcatctctcgccttatacaaaaatcaattcaagatggatcaaggacttaaatctaagacctaaaactataaaaattctagaagataacattggaaaaaacccttctagacactggcttaggcaaggatttcatgaccaagaacccaaaaacaaatgcaataaaaacaaagataatatgtgggacttaatgaaataaaccatgatctttaaatgggtttttctagctcaagaactacatgctccagaattatcaaaattctagaataaatgctacaatatattgttaacccatacatgcagtaaatgagaagactgtggagttaagcatttgcccatttgatgtaagaagaactagcacttaccatgatcagttatacttattacatcatttctgtccttgaagcaaagtccaaggtgtaattctaaaatagtataaactttatatcttttggacattggcgtgggtaagagcctattgtttttgttatgttatatctcagtggtcttgtttattctagtacaaagctgagaacagcaccattttgggggaaggagggagaatcagaggctggaagatgaaaaatagagagtaagaggttatggtgaaatactacaatatttaaaaaatttatcagtgactgttcttcattttaaaaacaaaaagcactgccctgagttggagcttagatttcattatttgaatcaatgtcactttgcttaatgccaagtgtattttgtttgtttctcaacaactggacttcatagatttaaaaatggtttttaattttttttttgtttgctaagactcaccttgaccttatcctgtcccatggacttgaagaactttccgatggatgtccagacctgtacaatgcagctggagagttgtaagtcaccactgttgaaatgactccctgcttgttttaaccaatgacctggttcttttagtatgtcattaaagagaaaggacccttacaactcattccctatatactgaccaacccccaacatcctaatggaaagacaaaccaaagtgtgtgtgtgtgtgtgtgtgtgtgtgtgtgtgtgtgtgtgtgtgtgtgtcatacaaaatctcattatcaatacagcataggcaacctttcaaagtaaaatgccaaataacttgcctttctccccccgcccaaaaaatagcctgatttggtaagcttttcattgaaatgaaaatgtctcctgagaaaattaaaattattagtcattaaatctttatagtgaatcactctttaatcagaaaattgaatttctttccatcttatgcccatgtagaccatcaccccaaaaggaattctggcaggaagggataattgctttgagaacaagacataaggaccttggccagaggaggatgtaagaatgaggggcatgagatgagatggaataagacagaataagaggcatttctcttagataagcagtggatacacaaaagcatggtgaagcaagtagaaaaaggccatctactttgtcccctttatgacctaaccctgatgccactaaagtctttgatatgtgtcaccataagttgctgatgcctccaaagtaacaggattttcagttaagagatatgaatttctttctggcttggtctatcagtttctctgtttgtaaaatgcagagaataataagtgccactgacctacatggacgttaggagatttaatgaggcatgggcaaggaaatacttttaacttcttggtttagaaaaagaatatatgtaaaaagacttatctattatttaaaaagaggtagtgacagggttgatttcattctgatcatctaaaatcactatggatttcccttgaaacatcccagagaaataaacaaaatgatgaaacctctttatcttaagaagttgtcatagataaaatgaaaatttctgatttaaaataggccttatgtattcatttttttccttattgctccttctcttgagaaaaaagctgagaaaaacattttcttacatgattccttctttctgttttctctactgctccaaaatctcccctgactcaacccaacacttttattttttctgtaaaacagtagccgtagctgtcaactgatgttcatccaaggcttagaaaatttgaattagtaaataagctcagtcctggcatgaataatgaaatcaaagaaacatcatgtttaccactaactttggatgtgaagggtgggaattattatttttttccttttctatcccaatattactttcttcatccccacctctttacctctgctgtcttccccatgctggggcttcagggtgactgacaagaacttttattgtggtggccaacgagaagctcaccagacaagaacgtggggtattttgtgagcttagagtagtatttgctggaggtttccaaggtgtactcacacagatagggtttgccattctccttgtggaccaccaatgcttgtatagggcctctttgtatctccttgctttccatgttcttattatttttttttttttggctttatgttgaaaaggtagtccaaagaaacaggaaagtagattacaattaaacttgccattgatttctgggtagctctggcgagtcactatcttgcagtaaataagaataagaatccataaacttaaaaaaaaaaaaaaaaaacatgctgaggattttggccagccaagacctcacataatatcctctgtcctcatcactcttatctgaaaagttcaaatattacaaacaaagggaaaaggtagagaaatggtgcatgaaagaagagtaggcttcatttctagggtagagaaagatccagaaaaaattgacagatgatgacctagcttggagactaagagctaactttggattaccaaactgataacaattttactttggatggttcaagtcatataaaaatatgatctttcataataggtaatctgttttactttgtattaataattgtgatgagtgggcccatttagcaagacactagcacaaatgaatattcttaatttgcatattccataatttcctcttagattacctgccaatagtcttccccatttgctaaagtagaaggactttaacataagctttctgaatgcaaagctaatagaccctaggaggagggccaagtctgtaatgggaatgttttaggcaggcccgtgattaattcattctcatttaaaaaaagaatggttttcatttaaagtactgactggcactgtggattggattgtcttattggattgctaaagcctcagctcttgcaagtaaagacaatcttcaaaggatttttatgtttgttcacttgtttgttcttcagaaagagttagtgaataaaaaggcagaaatcaatagactttttagattccattctttcattacacagaaaaaaaatccatccataagtagctttctgtcttaaatttctttggctccaatgacacagagttgtagtgatgattgcagctcttttattaagaatgctcttgaattgactgagcgtatgtctgctttagacagtttctttgtttgtttctttacatgggtagactttcaagctttcttggaaagccatattcaattttcactatgatttctttacctcagttgggtacacgatgaatgacctgatatttgagtggttaagtgatggtccagtgcaagttgctgaaggattgaccctgccccagtttattttgaaagaagagaaggaacttggctactgtacaaagcactacaacactggtaagtttctttttttttttttttcagctgttaaacacaagtgagcgccatttgcagtttggagtatacatctcattactctaattgctgcatatttaccaggcaaatagacctatgtcgcacggacctgatttggctcaaaactccctcaacagataagattcctatactctctggaataggtcagcaaacacaagaggtaatttctccagaacatagagagaaggagagaggatttaggatcttttgctgttcctagctgaccatctgttgtcgaatgagtctgaggaaagatgtagaaaacctcattagtggtgcagaaaacataaattctggctcctttctggcatccgctcttgccattggatgcttaggtcaatttgcacccactgtcttactgccttagtgccttagtggaaaagagggacaataacacaggtctttgtaaacccagaaatagagctgttgtgttcttcagtcctggatagcaatagaagtttggatgaaagtcagctggcaggaattcagctggctctaaagtcatgtgttatcagtagtgctgacagacacatggggttggggggcaggtggtgaaggaagaacttgaggtggtagcaacaaataggcatccgttgttttctggaagattttacctgtccagaaaagttgatggtttttcttaagaaaaaccatggtgttcattcaatactatgcaagctgatcatggagagacaatcaagacatgatggtttgtccagtaactggtctaggtcccttgctgaggaaaacagtttatgcacacttgttccaacagccaacagtgatacttatgaagtaaccaaaacctgattccaaggatgttttttttctgaccaagaagaattcaaccctatatcttgtaatctgtatggactaagcaaaattaccttctggagttctaactccaagtcaattaaggagaaaaaaagtgggaaggggtaggaatatctgtctcttaaatgttagaagttttaatacctttatatgaactcctttttacaggtaaagaaacactgtacgtagttcctaggcatatgctaaatgtcctgaagcaattacccagaaggctaggaaatttttacaatgactagactatacactggcttatacaaatgtacatttttctcttgccattaataacacaatgataaatacacagttctttaaatactttgtagttttatgtaaactgtactactttggaggaaatggcttcaactattacacagtgtatgtcatgtgttacatattatatgctatatagtatatgctattaatatataatatactatatataacatattataaccccccaaaatttgaatattttatttccactggttattttctgtcagtcttgtaaattctgaagctctgtctaaaacaatcaagctgcagcaagcacagattttaaaaattaaatatgctttatggttttggtccagtgactctttagatcacacattctcacactattattatcactattattccacagtaattatttctattactggttcagttggagaagagttgaattggttacgtagggtgaacattttgtgcaatcttccaaatccatctgcagtagtcttttttttttttttttttaaacaacgtgggataatggaattggaaatataaattcaggctggactttaaatgatcatttcctccttctaggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtaagaaatcttgcttgataacagatgacatgaaagcttcccaaaggtcttgtgggctggagagttctgtgaggacagaaatgttggccaccctatgacactgtcatagatatgaatgcaataagaggacaagaagctgagtttgagagaatcagggatctgggaacatggggaaccctcaaaatcatatcatttagaggaaagggaaattagtattgagagggaagagaaatgagtagaggcagaaacatggcttagagactctaggaagcccttgagtgcttttgatctcggttgtttataagacatgaagcttgcaagaattggagtaagactgatgcaatttatgccatattttcaagtatttattggtgaaactattgcaattcatatgtttagtgaagtcatttatagtaataaaaatttgaattaggctcctggaaatcacagaagagccatatcaataaatatatgtaagaaattaatgtacaatattagggtacagcaatctgatatatgaaacattgctatgccttaatttcctttaatggctgatatgctactatttttgagtgacacagttacccagagaaggaacagtagagtcatctaaaatggtgaaaattcctagaaatgtggcatggtgacagaggagtgtgggatcgatatcagggacatatagacagtttatagcacctcaaataataatccataagtggctgtgtaatctatttttataaaaagaaggccatctgcatttgtaaatattgcttaagcaagtaatgatgaatgtcccacttttgaaatgctctagcaccccagaagtgtgcctttgtgtgcttccccatttcactgagcacactgagccattggcttcaattttccagaatatgagtttaatttaggattcagtgtacattgtctcatactggttgagcagtctctccaaaatgcatttccggaaaataatgaagatgtaattccatatttttgctggcttgagtttatgtttggttgtgctgaatttgacataatgagaaatgttagatcatgttccacattatctcccatgtccagaagataagatgacatatggaggaggtctgtggttataatagaggtgggctgaatactggagaaatatttacacaacttattaagtcccatgcctccaaagataaacattaggttttatatggtcatagagaaaggaatagaggtatctctaatacttttttatcttctagaataacaaatagtataatgtacctgtattatttttctactggaatacagatgtcagaaatactaacagcttttttaacctgtataatcaaaaatcaattttacctaatagcacttttaatccactctgtgcccctcccaaacaggttcatttgcttatttattattagtcattagctattgccatcactgcatgccatggcattaaacctcaggatgtacaaacatatattttacaatttaatagacagctaaagtactggtgacaaactgtaagcatataatgtcaaaatataagacatttagcctccaactgctcattgctgtgaaaagagtagtcatttatcttcaaaatgggagtttgagtttttataaatttgttattcattttataaagctgttatgattctgcatcaatggtcaaaactattgctaaataaatgttcactgatcagggatctttgtatgtaaaggcaatgaggaactcagataaaccaaaagagagtaaaatcaaaaatcattttacacttggctctgaactcatggtggttatccttttgccaccattaggtttatcttcctctgtgtacttttcttatgctgttattaaacatggttggctttcaactgaccatgaggaaatgtaacttatgtggatgatggtgtgaaacacatgggataaaaagtgagtcatggaaaatgaagaattggtcatacagttacttatacatgcacatgcatgtaaatactcattttaatttataaacactgcaatccctgaccagatgctccactgtggtgattgtacatttacttcagggcctcctacaatgccccgtacagagtacacatgcacattacactttaaaagtaagatgtttgttatagaaaagacagaaaacacagaaaacatgattaatgttaaccaaccattaaataactgttgttaagactttggtgtattttctttcagtcttttttccatgtgcatttatgggcaagcccatgcacatgcacacacagaaaattgaggtcaaacttttacaccatcttagatatttagagttttcttttttgcttttgtaagtatgataattataaatacatttgcataggagtgtttgtagcccactgtgttctagataacatatatatagtttttaatttttaaaaactttcaatgagaaaaaagaaggtactgagcatgtttagagtgaatgagggaagatctatgagaagatatttgatgggatatatgttctatgcaggcaacaactttgtcttgttcattctgttaacttcaacacctagaacagtatgtggcttagactagatgaccaataaattctcatcgaatggataaattaatgatcagccatgttctcccatgtgaggccatgttgaagatattaggttggtgcaaaagtaattctggcttttgtcattaacagtaatggcaaatatcgcaattacttttgtaccaacctagtagatcagacttgaagcagaatccatgggtgaaagttacacagaaaagtatttgagttttaatgtacagaagaatctcataataatattacatgtactataaaggactggaatttctctagagtatgtctccctttccaaaaattctcaagcagactttgcaaagttaagaatatatgaacaaatttacaagaaaacaaacaaccccatcaaaaaatgggcaaaggacagaacagacacttctcaaaagaagagatttatgcaaccaacagacatatgaaaaaatgcccatcatcactggtcattagagaaatgcaaatcaaaaccacaatgagataccatctcatgccagttagaatggcgatcattaaaaagtcaggaaacaacagatgctagagaggttgtggaaaaataggaatgcttttacactgttggtgggagagtaaattagttcaaccattgtggaagacagtgtgacaattcctcaaggatctagaactggaaatatcatttgacccagcgaactcattactgggcatataaccaaaggattataaatcattctatgataaagacacatgcacaggtatgtttattgcggcactattcacaataccaaagacttggaaccaacccaaatgtccgtcaatgatagactggattaagaaaatgtggtacatatacaccatggaatactatgcagccatgaaaaaggatgagttcatatcctttgcagggacatggatgaagctggaaaccatcattctcagcaaactaacacaagaatggaaaaccaaacactgcatgttctcactcacaagtgggggttgaacaatgagaatacatggacacggggaggggaacatcacacactggggcctgtcggagggtgggggggctaggggagtgatagcattaggagaaatacctagtgtagatgatgggttgatgggtgcagcaaaccaccatggcatgtgtatatctatgtaacacaactgcatgttctgcacaggtaacccagaacttaaagtataataataataaaaatatgaacaaagacatattttgaaacataggccttgatctaaatcttagagcctttacttcactcaacctctctaagtttgtttcatcatttataaaatgagaacattattatctaccccttaaaaaaattaaatgaggatgagatgaagcagtacttatataaattgtttagcccagtttttctacatcgtcggtattcatctcatcctggttatttttattcttactgttccctgtccataatgtagtagaaaagactgctccatggcatgagaggttatattagaaaatgcataaagggccttatgaatagaagatgtcctgttctttggatggctcactattcacttatagttgtactgtcaatgagattaaccaaagtttgtcatatgtatgtgtgtacaagatacaattagtcctccatatctgcaggctctgcatctgcagattcaacaaaccatggatcaaaaatatttttaaaaaacaaagaaagcaaaacaacaataaaaaaaataaccaatacagcataacaactatacaatatttgcattgtattgggtattataagtaatctagagatgatttaaagtatatgggaggatgtgcataggttatatgcaaatattactccatttcatataagggacttgagcatccacagattttcgtatttgcaaagatcctggaaccaatcccctgtggataccaagggggcaactatgtacatatgcacaaatacacgtgtgtgttttttttacagatagttgattaaatgggttcagttccagagggtctgaataagatatgagtcaatttttccccactcactaccattaaataccctcacttggctatgtcttctctgcccctggaggattctatagattctcagtactatatgctatgctattagacctggaatgtacaaacgtgtatttttcaatttaatagacagctaaagtatcagtgacaaacagatattttaggatagtctattatcagacttttaaaaaattatctagtctgaaacaaaacttcagtctcatgtacaattcaatgctcttttcttcccttgccgcatgctcaggcctgacttgtgccttgaaaatgtacagcgatgtggagcactttgtctgttccttcacagttcctcccctgtatttccaacttttttcctcactcatgttgctgacttcaccattgttgagggctgagagtaatgggaaagatggaggaaagtctcatgtgaccgaagctgtggtatactattagtgccttctctaatggcaagcccccaaatgctggatttcttgtgaggtgaacttgagttctttggagttcccagggcatccaacatactacaccatttccagatgaataatgtattctctgggtgatgtcttaccatctcctcttagctatcacctcctagcagtatatcccatacaacttcttactcctcaggtccccttccttaataagatagcccttctggttgatgtattttccagatgactcacctttggctatcttccacaccatttattaggctcactaagaacttgtgcattattgccttgctaaatgatagaaatgcaacttaaccaactgctaatctttctgctttcaccctactatcatgggtattccagctaacctactgccttcaaaattcactcaggtaagaaagatattggtgttcacattttcatataaaacccaaatactaaagacaaatgagagattctcttaagaactctgatccaggggcaacttgttggaatttcagcagcttaccaaatatatggcatatggaagagataccagtctcttttcttacaggggtgggtataaaccaccttctatccatctttaggagaacagggagaatgccacagcactgtcaacgtccacaaattccattacttcaattaatgttttcgaatgtctggttttctgtaataatacagggtgttgggtataagagtctctagacagcattttctgtcttctagaaagtactgtatctggcatgtatatgtgcagcgtctccctttagtgtaaggctttagtaaaaatgctgaggcaataagaatatcctgttcccatactgttacacatataaatatacactcttaattttagacttttatccctatgagggcaaggacttcattgctcttggaaatgttcgtgtacccacccctcagcacaacacctggttcacagtaggtgctcagtaaagagtaaatcagtgaataaatgaacagtgttgaaaatacttgtaatcaaggggtattcccagtataattcaattgatgattcatccatccatttatttattcaactaacacttattgaatgttttatctgtgccatgcattcttctaggggtcaaagataaaacacagcccctaccctcaggggcttgtaatctgctaggccagagataggcatttggaatggtgattatttaacaatgtaggataaaaagatatatgaagtaagatgcctaacctattaagtggaggagggaagaatgggtgggtgaagaagggagagaagagagggggaaggagcaaaggaagtagagagagcaggagcagatctaggaaaatgtcctgaaggaggaagcctgagctgaatctacgaggcatattaagtaggtgaagtaggaggaggtaaagggcattccaggcaatgaggaccttctactcataatatttgggctacacttttaaaataaggctttctagaaaaaaatctgggtacatttcaaacatgcttcacacattttaaacacgtttcaagtaagaaacttgtgtttattgattccaagttaatttcctatcttcctgccaaccaatactttttgtgtttttgttcttgattttttgtttttcagaagttcaatcccttctctaaatacaggaaaatcaaataccagcatgatatgtgtttcatcggtatctttccctttgaagctataaaattggtttttaaacatacatctctgccaacccccaagaagctattgtgctggcaatacttcttttaaccgtttagagcataaagcctctagtggcagactaaaggctgcatgttgtctttcccaccctcagaaaagtatgaggatgaattgaatggaagatggaagactgagacatcaggcaggctttgcacatggcaaaataagattaaacgattattttcctttactccatgtttgttatcacagctagatgatttatagccactcctaagtgtgtcttgagtcctcatttgtggctgaagcccagagactatagaagtgaaagcaaacactgggatagctagaatgacctaggtgtgcagacgactctgacaggtccagaactgtctctttgaagcaaggatccagaggcattgtctttcgccattattaactgggatggcctatttcctatataaggaaatttctccttacttttcagccatctggtcaactaagaccagctggaccatttcaagcagctgacaaacccaggacatgcttggaatttaaaacgaaagaggccatacatagttttgccacatttggtcttgctttattccccctaccagaatgcttctaactagagattgcagtaagagaactacgaaaacagtaagactgatacctgtaggagtttttaaagatttgtttggatatctgttttagctctaaaaaataaagatgattgctccttgaatcaggtatatccccagctaatttaaacgactttcccagtatttctgaaagaagttggaaacaattattttttgtacataatcaggatcttatgaagttcttggataaagattaaaaagtaagaaagccaagcaaattgatctgcaggcctgcttgctttagccagatgtctgcatatgtaggagacttcataaactttccctcccgacatttcccaagccacagcaaattgaagagtcgttgatgtagtgagtgtgtgaaaaaaatatgcaaagagatgacacgtgagaattctctggggagagagctgaagcaccattggtactttagtttaagaatgttgttggcagcctttgcagggaagctgacagtgagagaagctatccaagctaggcttttgctcaagtcctggtgaggctcgtaagcctttggggatggcatatggaaattcaggattattttgaactctttctctttccatttcactaaaatgggtaactatgggtccaaatggcttgggttcttataaacaccacacagtgaggaaaaaaatgaactattgtggagcatgcaacacagtgtcaggcactatgttataatacatgatcacattacagacaagaagaaacagaacttctgtccttaagaagacataaacataaaatagaagattataattcagtgcagtaaaggcagatttttttacaaaatggctataataatttccctccctgtgtctacacccttgggtaatagcttcctcttacattgactgtaaacttgaccatgtgacttgtcctggtcaatgggacaatggcaaatgcagcaaaactagaggcttaaaaactgcttgcatattgaagctagctctctcctgctactcttgggatgctgtgaccactactatgtgactaagaccaggctaacctattgagtgataagagacacatggcccagttatctcaaccaccaggtgaggccatgcaaacacatgagggtgtccagccactgccatgtggaacagagacgatccatcccagatgagcccagaccaaatagttgaaccaaagaatcgtgaacaaataaatagctgtcattttaagctactacatcttggggtagtttgttacacagcaaaagttatggctgctaagaaggatccttgatctagtctggaacttcctggaagaagggacatgaggaagcagcacctgaactaaatttttttgaaaatagatgaagtttttatttggacacaaattcttaccaccaccatgttttaaataaaatgactgatattaactttagtgtccttggaacaagtctataataagaatataggataagaatataagaatatcgccatttagtctggtgatgttctttctaattttgaaaccactcttaaaatttaccatttcttccaggaagctttctcaaattctttggaaaagtttcctcatagctttccataagaagaagcctcaattaggcaattgttatgtgcctacctctctttataaaatatctctcatggcccaggaaggagcaggatgctgatgataaacacaccaatttgagcactcactaacaattgggcaagtttccatttttgtacatatccttatactaaatatgctcatttcatgagacagaattatgtgtttgtatacatgcatgataatgtagtcatttatgtaaagggtattatgtttatgaattaaacagagatatagtatggtaatgtttatgtaaacggcattatgtttatgaattaaaataaacatatatatagcataataaggaatattagaaagctttcagctgatgcagtaattttctgttgctgtataataaactttgctacttaaaatacccatttattagcttgtaattctgtaagtcaaaagcctggcttagcatgactgggttctctgcccagggtcttataaggctgaaatcaaagtgtcagctgggatgaggttttctttggaggttctgaagaaaaatatgtttccaagttcatttttgttgctggcagaattcagctccttgcagcagtagagatgaggcccccgttccttgctgctggctgttagccaggggctgctcttagtttctagaggctgtacacatttctttacacgactgtacacatttcattacacgtggtgccttccattttcaagtcagaaacagcacattagttccttcgtatatttcaaatctttgacttcctctatacccagatttaaagggcttgttaattagatcggacacacctaataatctctgtgttttaaggtcaactaatttgggatcttaattatatctgtaaaacccctccataacagtctctagatcagtgtttgatggaataactagcaggattatgcacagccaggactggaactcttggggtcttgggatttagaattctccctaccacacctttgtactggaatattctttggatagtctccctgattccattttgccttctatattgtattttcaacacaacagccagaaaagtcctatttagcacctccctgttgaacatcttcccgtagctccctgttgaacatcttcccatagctccctgttgaacatcttcccatagctccccatcccactcagagcaaaagccagtgtcctcactatggtgaacaattcataatctatcccctatttcctcttgatctcatatcccactaacctaccccctagctcactgcttcaggcacactgaccttcttgctgtttcccaaatatagagggcatgtgctctgggcccctgcaatgattgttttctgtgactggaatgttctgccctcagatagccacttgactaccttctctaccttctctaaatccttattcaaatcttatcttctcagcaaagcctggtcattaccactctgacctaggctctcatcaataccctgacctgattcaactttctaattttttttttgtttccccgcagtactttattaccttatagcaacactatcatttatatcaaactctattatggattatgtttattgtatattatctgtttcccttagcttgattataagctccatgaaggcagggttctttatctggcttgctcccttcaatagcatctagctcacagtatattctcaataaatatttgttgattgaataatgaatgaacatctacatctctagagttgggtcactgagaactatccatctaacctttatctaagatatgaaaagaataaaagggaacctacctagccaggcgcccccccgtttttttttttactggttattctttaccacagagaatccggctgcatatagtatgttattctaatataataacattttataagtttcacttctctgatagtatcaagtagtgttacatttctttttctttgatatatatttcttacagagtaatctaatcaaagatataataataaaataaaatagtggtttagataagagggcatcaagacagactatttttacctcagctttgcttcctcagcactgtcacaactaatttgggggtttctcggtgtgctgacgcaagcctccattgtcccttctcgcttctccagttttttaggatgcaggcttattctctgaattctgataaaggtgtctaaagatcttctcatctggactctatacagcagctctggaccaaaggtacagccccacactcttccacaggagcccaaatgccagaaaattagcacctttttctttatctagcaagaactgagtaaggttttattttccttgatcttaaggtgtcattaaagactatctgtgcatttgaatctaaggattgctttgaacttcatctaggacttaagaggccatgaactccaatctgaaacaaactacaaactaaagcaaaccattttccatcctttatcacaaaatggggactgggactgcagtttgctttccaaaaatgactataacttaaagaaactggaatatcaaatatattccagattacacatggattggtctcataaaatcttagagttctgcgttagtagagcatggggcctcagcaatcttgttagagatgagaaaactgatgttgatgaagattaatccacttttcaagagccacttgaagtagatgtcacttcttacatgaaccccttatggtttgccattaggtgtaaatggcctctcttccttacttccacgacgctttcttgcttccatgccactttcaatcattgcattctgacatggggcttagtgatcagggcccatgtgtacttgctctaacaaactgtactataaattccttttggagaaggccatatgtttttcaactttgcatgacccgtatgacttaaacagaagagcccgtaagtagttattgtggaagtactgtaaagagacagtgttcagtggctcctgattctctgtgatcaaggtaagaattagtgttggagtttgtcttaataaggaagggtctctaaagcagggacctcaaactttgctacacattagaatcagttgaggagatttcacaggtttcccagaccctaccacaaattaaaccaaactatctgggcatagggtccagacatcagcattttttttttaaaactaaaagtttgttctgattatttgttcttttttttttaacactttaagttctagggtgcatatgcacaatgtgcaggtttgttacacatttatacatgtgccatgttggtgtgctgcacccattaactcgtcatttacattaggtatttctccgaatgctatccctccccctgtcccccagcccccgacaggccccggtgtgtgatgttccccatcctgtgtccaagtgttctcattgttcaattcccacctatgagtgagaacatgtggtgtttggttttctttccttatgatactttgctcagaatgatggtttccagcttcatccatgtccctacaaaggaaatgaactcatccttttttatggctgcatagtattccatggtgtatatgtgccacattttcttaatccaatctatcataggtagacatttgggttggttgcaagtctttgctattgtgaatagtgctgcaataaacatgtgtgcatgtgtctttatagcagcatgatttataatcctttgggtatatacccagtaatgggatggctgggtcaaatggtatttctagttctagatccttgaggaatcgccacactgtcttccacaatggctgtactagtttacagtcccaacaacagtgtaaaagtgttcctatttctccacattctctccagcacctgttgtttcctgactttttaatggtcaccattctaactggtgtgagatgtatctcattgtgcttttgatttgcatttctctgatggccagtgatgatgagcattttttcatgtgtcttttggctgcataaatgtcttcttttgagaagtgtctgttcatatccttcgcccacttgttgatggggttgtttgatttttttcttgtaaatttgtttaagttttttgtagattctgtatattagaacttagtcagatgggtagactgcaaaaattttctcccattctgtaggtttcctgttcactctgatggtagtttcttttgctgtgcagaagctctttagtttaattagatcccatttgtcaattttggcttttgttgccattgcttttggtgttttagtcatgaagaccttgcccatgcctatgtcctgaatggtattgcctaggttttcttctggggttttaggtctaacatttaagtctttaatccatcttgaattgatttttgtataaggtgtaaggaagggatccagtttcagctttctacatatggctagcaagttttctcagcaccatttattaaatagggaatcctttccccatttcttgttctcgttaggtttgtcaaagatcagatggttatagatgtgtggtattatttctgagggctctgttctgttccattggtctatatatctgttttagtaccagtaccatgctgttttggttactgtagccttgtagtatagtttgaagtcaggtagcgtgatgcctccagctttactctttttgcttaggattgtcttagcaatgcaggctcttttttggttccatatgaactttagttgtttccaattctgtgaagaaagtcattggtagcttgaaggggatggcattgaatctataaattaccttgggcagtatggccattttcacaatatcgattcttcctatccatgagcatggaatgttcttctatttgtttgtgtcctcttttatttcgttgagcagtggtttgtagttctccttgaacaggtccctcgcatccctggtaagttggattcctaggcatttcattctctttgaagcaattgtgaattggagttcactcacgattttgctctctatttgtctgttattggtgtataggaaagcttgtgatttttgcacgttgattttgtatcctgagactttgctgaagttgcttatcagcttaaggagattttgggctgagacaatggggttttctatatatacaatcatgtcatctgcaaacagggacaatttgatttcctcttttcctaattgaataccctttatttctttctcctgcctgattgccctagccagaacttccaacactatgttgaataggagtggtgagagagggcatccctgtcttgtgccagttttcaaagggaatgcttccagtttttgcccattcagtatgatattggctgtgggtttgtcataaatagctcttattattttgaaatacgtcccatcaatacctactttattgagagtttttagcatgaagggccattgaattttgtcaaaggccttttctgcatctattgagataatcatgtgtttttgtcattggttctgtttatatgctggattacatttatcgatttgcgtatgttgaaccagccttgcatcccagggatgaagcccacttgatcatggtggataagctttttgatgtgctgctggattcagtttgccagtattttattgaggatttttgcatcgatgttcatcagggatattggtctaaaattttctttttttgttgtgtctctgccaggctttggtatcaggatgatgctcgcctcataaaatgagttagagaggattccctctttttctattgattggaagagtttcagaaggaatggtaccatctcctctttgtacctctggtagaattcggctgtgaatccatctggtcctggactttttttggttagtaggctatcattgcctcgatttcagagcctgtcattggtctattcagggattcaacttcttcctggttttgtcttgggagggtgtatgtatgtgttgagtaatttatccatttcttctagattttctagtttatttgtgtagaggtgtttatagtattctctgatggtagtttgtatttctgtgggatcagtggtgatatcccctttatcattttttattgcatctatttgattcttctttcttttcttctttattattcttgctagtggtctatctgttttgttgatcttttcaaaaaaccagctcctggattcactggttttttgaaggggtattttgtgtctctatctccttcagttctgctctgatcttaagttatttcttgccttctgctagcttttgaatgtgtttgctcttgcttctctagttcttttaatggtgatgttaggttgtcaattttagatctttcctgctttctcttggggcatttagtgctataaatttccctccacacactgctttaaatgtgtcccagagattctggtacgttgtgtctttgttctcattggtttcaaaggacatctttatttctgccttcatttcattatttacccagtagtcattcagaagcaggttgctcagtttccatgtagttgtgtggttctgagtgagtttctttatcctgagttctaatttgattgcactgtggtctgagagatagtttgtaatgatttctcttcttttacatttgctgaggagtgcttacttccaactatgtggtgaattttggaataagtgtgatgtggtgctaagaagaatgtatattctgctgatttggggtggagagttctgtagatgtctattaggtctgcttggtgcagagctgagttcaagtcctggatatccttgttaactttctttctcgttgatctgtctaatgttgacagaggggtgttaaagtctcccattattgttgtatgggagtctaagtctctttgtaggtctctaaagacttgctttatgaatctttgtgctcctgtattggctgcatgtatcattaggatagttagctcttgttgaattgatccctttaccattatgtaatggccttctttgtctcttttaatatttgttggttgaaattttgttttatcagagactaggattgcaacccctgcttttttttgttttccatttgcttggtagatcttcctctatccctttattttgagcctatgtgtgtctctgcatgtgagatgggtctcctgaatacagcacactgatgggtcttgactctttatccaatttgccagtctgtgtcttttaattggcgcatttagcctatttacatttaaggttaatattgttatgtgtgaatttgatcctgtcattatgatgctagctggttattttgctcgttagttgatgcagtttcttcctagcatcgatggtctttataatttggcgtgtttttgcagtggctggtactggttgttcctttccatgtttagtgcttccttcaggagctcttgtaaggcaggcctggtggtgacaaaatctctcagcatttgcttgtctgtaaagtagattttatttctccttcacttatgaagcttagtttggctggatatgaaattctgggttgaaaattcttttctttaagaatgttgaatattgtcccccactctcttctggcttgtagagtttctgctgagagaactgccagacatcaacattttttaaagctgctcaagtgattctaatgtgtagccagggctgtgaactgtaactctaaattttactgttatgtggggaagtgttttcactatgtttactatgtgtcatttaaagttcacatcaacccaacgaagtaggtactattattatccctactttatagatgaggatactaaggcacagaagggttaaataccttgctcaaggtcatacagagctagaccttaaactagagctagatctcgaacccaggcagtctggctccaagttggtgtgtttaatcattatgccataccacttttcatagtgaacaattattgagctccttttagatgcctttcattgtgctaaacgctttacatagattatctcatgacatccatatgaggtaagtagtattttgcatcaccaatttatatgtagggaaactaaaacataaatagcttaagcagtttgtggacagttacatttgtagcaagtgaagaacccagatttaaatcagtagtcaattcaaatcctctaaaaggaagaactaagaattttaagtcccatcacattgtccatactatgctaattataggcggtagcccttatttgtgaaataagttattttctagactgtgaaatccctgtcttttggctatgcatactgaattcactgtatattacatgcagttcacatattgtttatcattttattgaagaggcaatgcttgcctgattgccctttctctttcatattaggaatactttataatggttcctgaggcttccagtatgcaccctggatttgttgacaagcacattcctcctcagcacactttctcagtttaactcagttgctgtttattgcctctatcagctgtagccattttaaccatcattttcatcaattcacagcatgtgagattatgttaagagcccaaccaggtataagacattaactgtcattcagtggcaactaaaaggttgaaggaaagcacattggatgatcattgacaataaaatggttaaaaagattgtagcctattcattcaataaaataatagatgtaaataaaaatgaaggaactgcagtcacacataacaagagatgaatctctcaaatctaatgttggggaaaagttaccaagaacaaaagaatatttgctgcataattttatgcttattcagttgaaaaagagcagggaaagttaatctatggtactcaaaccagaattatgattggatttggaaattagggaaagtagcgattgagagggaccatgaagagctaggttttcaggagcaagtaatgttctatctcttgacctgggtagtggttacatggttatgttcgttttgtggtgattcattaaactatacacttgtgatctgggtacttctcaatatttaaaaaaataagttaaaaacggattgcaacaataatgaatccaaatagagaacactcacataatttaggaagtttcctctttttccttttccagaataaaaataatacaagctgatatttattcactctatgtgccagacctgcttctaagtgctttttattcatatattatttaatcttctcaaccctataagatagatattattggtcttagataagtaaattgagtctaaactttacaactaataagtgccaaagccagaatccaaacttcactggaccctaaaccctattcctttttcactatgctgctctccttcccattttatagtgactaatatcccttcaacctttaaaatgtatgtcctccatgccagttacagcttgtacgcttaagggttgattgatgggactggagggttttggcagcctagagattctttccatatttaagttcacaattttgagtaatcacagtaaatcctccatctagttctgaattctcactggaacagtcccaccttttatctttagcttcccattgctgtttcctactcacttcctgaacaactctttcgtatggaaagggttattaagagctttctgtcattggagagaatctgaaggtaggtacaagatattaaacagaaattggcacctaataatgtttcttgccctatgtaaccctaagtaaaagagttcttaaaaaatgaattaatattttgtaattggctcatatggaagaccgtttcgttttacaatgaactttgttagttccaaaccgtatgtgtagatttctctttttgtgggactctgtagaaagtatgctggacaaatacggaaatagcattgattataggattagtctaatataatttcaacaggcaagaattaggtaatggtcatagacacagcagtccagactttcaagtatagtgagggtatcgtggtttgacagcaccaagacgtaaattcattttggggtatactaatgtccaggcatattggggattgcttgttgggccaggcataatggggattacatgaggacaaagatgattcttttactcatttatttagtttttaaaatatttacaatatattctgaattctaagacatactttttcaccttttcacatttctgagtttgggttgcgtcttaaaattgaaggcaaaatagaatttaattagagatgtttgccttagtggcatataaaataatggtgcatcttatgattgctggcatcttagatttaatgaactactatcctaagcttctagagccagccacagtgcttggcactgggcatacagaagtgagtaagacagacatgttctcagccctcagagagctcacatcccactgtagagacaaatattaagcacaaattaatagataatgcttattaagaagtaactctgtgtgtcatgagaacatgtaagaaggaaactggtgcttttccagttttcccaaggaagtgaaggctaagtgggattttaaggcttaataataggtacctatataaaggtggcagaggacaaccccagaaagggaaactggtctgtaggatttgaagttggaatgagccagtaaacttcagagaattagaaagaaagactgtgtggctggaatgtagaggacaaaaggggaaatggcaaacagggaggcacataggtcacacaggacctcatgggccctagcaggaagtttgagtttcctcattatggggatgtaacataatccaattaatttgtttaaaagggctgcactgattactgtgtagagtaagatttgagaggggatagggtggatgtagggaaactagttggggagctacagctataacaagggagaggtagcttaggcgagatactggctgtcggaatgaagataaatgaatggattcaagataaatattgaaggtagaattaatgggacatagcaattgattatatataaggaattggtggagacagaaatggggccaaagccaactactgaagacacatcataagggatgaaaaaatgaagacccataggcttgaccgaaggacaacacatcagggttggaaggaattggggctttgagtacagcctggtgtcttgtaactcaggcatgaataatagagaaggaaggctgtgaggaacagtgaaaagccttccccataaagcactgggagcacaagaagcactgatttgtagcttacttaccaattagtgtcattaggtaccgaagcatacttccccatttagggctattgttggagcacagtgtgattcagtagtgcccatctgaaccagaaaagtagtgggagagttcattgcctgtggttttcatcaacaggaaacagtaactgcagccctacctctgtgacaccaccataggttcatgaccatcagcctttggcagaaaacaccactcaggggtttttaaattgagatgtttagaccatttcgatttcctatgactgttgatatgtttaggtttaaacctaccattttgctatttgtctttcatttgtcccatttgttctttgtaaacttttcctaccttcttttggatatcgtattttttaatgcatgtagcctttgttagcctattgtccataactctttttgtgttttttaaatgctttagggtttatagtacatatattttacttatcacagtctaccttcaactaatattatatcccttctcatatagtataagagccctacaaggcaaacttctatttcttctcctccagcttttgtacaattgttgtcatatattttatttctttatatatcataaaccccacagttcatttttattatttttgtctaaacagccaattatcttttaaattattccactaatttgaaaaaatcttctgtattcaccttggtagttaccatttccaatgtacttcatttcttgggtagatacataattccatctggtatcatttttcttttacccatgggaattattttaacattttttatagtacaagtttgctggctgtaaattatttcagcttttatacgtctgaaaagtcttttatttcatgtttgttttaaaaagatatttttattggttataaaatattagatggaccttttttccccctaataagtagcttaaagatgtttctctaattgtcttcacacttgcactgtttccaatttaaaaatctgctgtcatcttatatttcttcctgtgtacataatttgtcttttttcctctggtaattttaactattttcatttttatctggttttgagcaatttaattatgatgtggctcagtgtaattttcttaatgtttcttgtgcttggagttcatcaagcttcttagatttgcagatttatagttttcatcaaatttggaaaaaatgtatccattagtttctcaaataatttttctgtacccttttctgtatcctctccttcaaagacttaaattacatgtacatcaggctatttgacattgttatacagcttactaagcatctgttctctttttggtcctttatttttcctcttagtccatttgtgctgctataacaaaataccacagactgggtaatttacacagaacagaaatgtattgctcacagttatgaaggctgcaaagttcaagatcatggcattggcaggtttgtcgtctggtgaaggtttggtctctgcttttttttttttttttttaataccttaagttctagggtacatgtgcacaacgtgtgggcggtctctgcttttaagatagtgctttgcacactgtgtcctctggaagggaggaacactgtgccctcacatggcagaatgcagaatggcaaaagaggatgaactccttccatcaagcccctttataagggcacctaattccattcatgagggtggagtcctcattactcaatcacttcccaatactgttgcactgggaattaagtttcaacataaattttggagaggacaaaacattcaaatcatagcactctgtttcattttagtttttactgtcttattttcaaattcattaaccttttcttttgcaatgtctaatttgctgttaatctcaattcagtatattttccatctcagacacagtactcatctctagaaatttgatttgggtcttttttatgtcttccatgtctcttgttaacctagtcattcttttatctagctttttgaacatatagaatgtagttatagtaggatttgatgtccttgtctgctaattctaatatctgtgtcaattctgggttggctgcaattggtttctttttctcttaatcatgtgtgttaatttcttgcttctttgtatgcctggtaactttttattagattccagacattgtggtttttatcttgttgggtggtggatatacatataattgaaactttctgggacagttacttggaacaatttgatttttttttgtcttgctcttaggattttttagataggcaagacccctttgagcactctatttaataccttatgaatgatcaacttttccagtctggcttatggaaacaagaactgagaactgcaagttctgttttctctaattcttttgaagattcttcccctagcctcagttactcttctcacatgcatgcacttatcagtactttgctgagtgctccagaggaatcctctgcagacctctggagttcacacatacatatacaccctatagacagagggagagagtgtatgtgtgtgtatatattgtcttgtgtgtgtagacatatatagacatacatatgtatatgtatatatatagacatacatatgtatatgtatatatgtatatacaatgtatatgaagacaatatatacaagtgtcttcattctggtactcttctctgtgaacttcagcttctgtggactcaacagaccctcagatccatcttttcaattctgggaattggttgggctctgcttagattcctcctccttgcatcatgacctagaaactttctctagacagtaaactggaacaatagtaggcctaacctcatttgtttcctacctttcagggatcactgcccttttttacttgatgtcttttgccttaaaaaccattttccaaatatattttaaccaaattttttagttgattcaggatggagggtaaatgtggtccctgttactccatcttgacgttaagtggcaatcactgccatggttttgaatccttgatttctttttaaaatttgacatggaatgtgaataaattgaatgtgacaatgtagataattgaaataattatcacaactagcattagcttgtaaatgcttagttcagttgttctaatcaatgaagactatttattaaatatatcatccatgaactctaagactgagaacaaatttttgtaaaggaattaataattggtatgtacagtaataaatattaatattctaatagaaatcagttttgttctacaaaatgtttcatcaaaaggtttgtttcaaggtaatatcgttcaacatatttaggcttataattgctgattcttaactctttttaaataatacactgtagactgctttggggggtaggggaccttattcccatccagcaacctctttctacatgtcaacgaaccatttttcttaatggttcatacttaacgccatggatgctgccactaaatcacatattcactttaatttggtttaaatcaatttaataaatattcaaggtacacatactgtattaggtattaaataggtcaaaaagataataagatagtttcttccccatgaggaatttatgatctagtacaagagtcagcaaacatcatctgcaaaggaccacatagtaaatattttaggcttgcaagccataaggtctctgtcacaattattcaactctgcagttgttacacaaagacagccatagacaacatgaaaacaaatgagcatggttatgttccaataaaaccctgatccaatggaaaaaagcagagaaacacaacatagaacaatagatatatcacaaagatgaccagaaacaagtgtcatgggatgtcaaagaagggagattcatatcttaatacttgatttgtaaatacaatgaattggctaggtgcagcacctcacgcctataatcccagcactttgggaggctgagttgggaggactgcttgaggccaagagtttgagaccagcctgagcaacatgatgagaccctgactccacaaaaaataaaaaattaactgggtgtggtggtgaacacctgtagtctcagctacttgaaaggctgaggcaggaggatagcttgagcctagttgttcaaggttatagtaagctatgcttgcaccactgcactgcagcctgagtgacagagtgagactgtatctctaaaacaacaacaacaacaacaacaaatgaatgatttaagagaggcagcaatatctaagctgatgtatttagacagaattacgaaaagcaggaatgacagggtgtattagtccattttcacactgctataataaaatacccgagactgggtaatttataaagcaaagagtttaattgactcatagttctgcgtggctggggaggcctcaggagacttaaaatcatgatggaaggggaagcaaacacatccttcttcacaaggaagcaggagagagaagtacagagcaaaaggggaacaaccccttataaaaccatatagtgcatgaaaactcacttactatcatgagaacagcatgggggaactgcccccatgatctaattaccttccacaaggtccatcacccaacacatggggattacaattcagattacaattcaagatgatattttatttttatttatttaattttttgagatggagtctcactctgtcgcccaggctggagtgcaatagtacgatcttggctcactgcaacctccgcctcactggttcaagcgattctcatgcctcagcctcccaagtagctgggattacaggcacccaccaccatgcccgactaatttttgtatttttagtagagacagggtttcaccatgttggccaggctggtctcaaacacctgacctcaagtgatccacctgcctcggcctcccaaattgctgggattacaggcgtgagccaccacacctggcctcaagatgagatttgagtgaggatatagagccagatcatatcacaggagaaaacctgaaataactaacagtgatgagtaagcactgaagattttgggaagaagtacatagttctgtttggctggtatgttgattatactaaggagtgtaatagaaaaataaggaaaatgtaaggtctttggataaaccaaggcagaaataatgtcttcctcttgtagacctgcgaagctcctgtctttggtcttttattttattctgccttatattatggttatttttgcacttctgtttgttcctctactagacaatcttcacatttagggcagtgattatatcccattcaactttgaattctcattgtttctagcacagagatagaacccagcagcagagcaaaaatattgcatggttagtaatgaaaacatccacttcaagcccaaaccatttggacttatcaaatagacattgaggtcctacagaaatggtttaaagactagcctactgacaaggaatgaaaatgttcattccttatattagcacctttatttttcaacaagggctttggttagagatctttcaactttatgtgcgttaattccctcataatgtagatttgaccatattagcagccacttgaaatacaacttctaagttgcaattctccacaatctgtttcgaggagagaatccagatggataagtactggggttttagtttttaatcaaaaggttaattaagtgaattaatctttatgtttgaatacattttgcatggaatttggagtaaataaatgggttaaaatcaaatcagtataatattaaaatgaatactaaagcttaggaaatgagttaaaagcttatgcgttctattatgtagcagcagacaaaattgtctatgtcaagtttaacctgagaagagaggaaagctgctaataaagtattctcaaatcctcctggaatcactagtatcgtcatagaaatcattttttaaaatgtataatgtttcacagacatagtttccaagcaattctttaaagaaaaacaccaagcagttagcatttaaataaatcttttgaattgcaatgagagtaaataactgcagaattataaatgagctgtcatgtccactgagaaaatgaagacagcaaaaatggaatctgaccacacacatgtggctgagggaagaagaggccgaggataatttaatgaagattttctagaagcaaatagtgccaccatccgtcatgaggatctgtttctataacgcttgtgtgtctttgagactacgtaggtggtagcttatgagtagtaatgttcttttgttagtaaatgtcaccaaataagcaaataagagaaacatgaaggccaaaaactgtgttactattcaggagaaaatggacggtttagcaacaatacaatgtagacttcaaaatatgaaaaatcaaggaaatttctgtcattgtctttaagggcctccagagaagtattaatttgttctttatgtgaatttaatgagatcatgtgaaatgtatgtctcatgttatgtctattgaaaacaattcctagggagaaattttgggtactgtatatttcctatccccaaatcatggggatcaaacattgcagtttgaattgagagcaaagagatgcttccccttgtgccctaatagaatcactgctcctggtatttcctggaccaactgagattgggtcaaatgaatatgatagggtatgtccaagaaacacaggagccaactgaatgagttcccagtgaccaaagctggaactatttaagcaacaaaataagtaaagtagtattgaattattacccacatcgtaaaacaaatatccataaggtcatactgatataaataaatgattgcataaaaataattgaggtagaaaaaacaaatctcccatgcagaattccaaataactcatatagatatattctgccctcaaggaggtagagcataactccctattacttaaatgtgggctgcccataatgacttcctcccatagggtacagtatggaaagtagaaaaaagagtaactttacagtagagaaacctgacaaatacgaccttagtcaggtgatcaaggtcagtatcaacaataagtcatattgattgtatataacctcggtatgatgtgatgagaagggcactttatctctgtggtcttccttccaaaaacatataatcccagtctaatcatgaggaacacatcagacagttcccaatggagggacatgttacaaaatacctgagtggtattcagcactgttaagttcatcaaaattaaagaaagtctgataaagtgtcacagctaaagggatcctaaggagagaatgataactaaatgtaacatggtatcctggatggaatccttgaacaacagtaagaaaaaaagttagataaaaactaagatatcagtattgatctattaggtgtgataaatgtaccacgccatagtaagatgttaacactaggggaaactaggtgtgcggtttatgaaaactgtattatctttacaactttctataaatctaaaactattctaaagtttttaaagtttattttaaaaagtgataaatatttgaaagcaactgaaatgtctcagaatctaagaatggatgtgtgcttaggcattcaaaatggactggaaggctggaaaaatctggaggaatcctctttctctgtctctgaataagagacctaatttgttctattctctctctcattcttccttgtcccttatccacaaaaggtagaaagcctggctatggacagtgccaagatattcatgttaaaaaaaatactagacacctggagaggaactgctctttcttttgacccaattccacattctcagaggaaaggatcattcactttgaggcaggagttcacttctgattcctatcatctgtgatgggggtagggtcagggaagggactctgattagcctagcttaggtcccctgatcaccctggacaaatgaattgccatcaagtgagtagagttacatgtatgtacctgacttcccagtgtatcacccctgtggatggtggggaactatgggggaggtggaatgagaaagaaaaggcgcttctcccaggatgaaaagtggtggaaaggacagaacaggttccacccaataaagctaaaggaataaaaataaagtatctaagtgagagagggagtagacttaatatgaaacataaatatttagcacttctgaaaatatgcaggtctaaaatcttctatccacacttatgaaatctcctaagctctgaaaaccaaaaggtttcccacagctcatttggcagcaaaacctgttctgaactgatgggaggctaattataggctttgcatatcccatttagtgtgaatattcatactgttttccaaagaaatattaatgtgtttgattacagggtcttccccaagccccactgggagtaaggggcatgtaatacattgtatacgtcacagtattaccttaataaaatctgaataactctgagttacagtgcataattgctcccacaggtttcatataagggatacatttataatactacacataatcacataaataaatgtccatttttatgtagctctgaaaacaagaaccacaaaaataaaaaccatacaagaaaacaaacatgctctttttttaaaccatctgaagaagtcctggatataagcaaggctaatactagtattacattttagaaataaaagaggggtacttagagaagattttactagagacagggtagggtctgagtaccaggtctcctaaccagtaatccaatgtctttgaactgccaccctgcatttcagatgaaaaagggttattgaaatggcattgttagcatgtaggtaaaagggtaacaaaacaacttaataggtggcttctttgatatttggagaagtatgaaaaggaaggtttgccaaggatttttggggagggtggtggtgggaggatggagtagagttgactatataggaatctgcacaatgtactttcaaaacctataattataacttttgccatatcttcaaaaaaacctattttcatggtatttttccttgcttttgcaactaacagctttcatgatcttctttattatttatatgaaggccaagtttcaaatattgtttctcattcaaataaacatgtggccatttactaatgaggaattttattttgttatttttacattaatggtaataatgaaatattatttttatccttccataaaccaatgatttccattacttttgggtttgaggaccttccttttaatatcaaaatatgccatgtctcctagatgaaagtaattttatgtttggtatcaacttcctgaaaatataattgcaaacacaaaaagctactatgaattcaggtacattcacaccagcacctatatgcatttgataattaggagcatataaatagaaagtataatatttattctactcacaatgtgttgtggaaatatgaattcctagaaatgtctaaatctccttgtattatagtccattcctgttttgactaatttaataaaatttactaatattaaaagccaaacagagtaaatggaatttaaaatatatatttgatatataattcaaataccataatgtgcttagaataatgcctctcacaaaagtaggcactcaataaacacttgttgagtgaatacctaaatactcaaattcttggtgaggcagtcttctacagtagataaaacatccagggttcatacttccttggatctgaatcctttgttgctggtaaatacccttgatcaagccaattattacacttgctacctcttaaggctgctgtaaggtcttacatgatatattccgtaagtaaagtctaatgtggaatattcaataaaaggtaattatctttctctctcttccttcaaattcctgctaatcttcctcaaggagtcactcaaacttccttcccaggagactcaatgggaaccacttcccagtgctgagaaatatgacactgtagaccttatccctcatgagggcagagaaccattgtgtacccagcacagcagacatcttggtatgaagcaggtgttcaatatgtatttgttgaatgaataactagaggaaaattaagaatttcccaatggaggaaatcctgtatcagacaaggaaatccttaacatttaaatagttaaattaggcaacttaacagtcttagaggaaaattccctcctgcactgcaattacttatgtttttctctattcagtgacaatgcttccctattttagtgccagtgtgggaaccccagggacaactgtcaaaaccagctcttcagttctgtgccctgtgctttctacccctcaaacactgcacatcattagcaatgctgagacttgtgttgcctttgtaaaatttctaaattctaacaaatgcctggagaccctaccaaaacaactgaaactggtgtaaacttgaggaaagtttactctcatttaaataaatccctgtttgttcacttgccttatttgttctttttactgtgaatgttttcatatagatatttaaaaactttattacttggcagaatatttgtaatgatacaaagaactgctacacagatgttaaaaatattcatagtaaaaagtttttaaatgatatatagaacaagtatatttcatatgtgaatttcacatatttggtgatccaagtagtattcccaattggaagaataccttgcaactctgttcctatgccattgcatggtttctccttctttgcattgtcacagtatagtaatgcccaacccaaaccatggcatgtggatacacattttaaattgatataatttttaatgtttgctttccttaaggatttgtgtttattttttttttaaagcaagtcttaaacttcccactactttgccaagagataggcaatatacaacaggcacttttaagaaaggaaacgtgcaatgcctcaccatgtttgcttggaagatccctaacattacgtggtaaactcatcacaaaaaaacgtaatcactcagcaaatatattgcttgtaccatgagcaaaggaatatcatgcaaatgaaaagaaaataaaaaagagctaaaatgtcctgttctatcgcaagtaaaacatttgtcagacacaaagtcttcttttcctttttctcagagtaaaacatatacattaaaatgcataaaatgcccatgtacattaaaatgccataaaatgttaagggtacaattcataaatttttatatatgtatacatttcagatcaagatatggaatatttctagtgtcctaggggtaactactgttctgacttgtttaactattgttacttttgcctcttactgaacttcatataaatggaattttgcagttcgtattctttcataactggcttctttcacaaaactcaatccctgtgggatgtatctgtgttgtttgtataactgtaattttttcccttttgttgtccgttctcctgttggtgggcatcacttccaggttttagattattatgtattaaatcttctatgaaaatttggtacatacttttgatggacatatgcacacgtttatcttgacaatatatatatatataggagtagagttgctgggctataaggtattgacatgcttgactccagtgtgtattgacagttttcccaagtggttgacacaatttacagtcccctagcaaaatatgagagttccaattgctccacatccatgtcaacactcattattgtcaggttgctacttttttcaatgtagccattcagatgacgtttagtggtagctcattgtggttttaactggcatgttcctaactactaatgataccaagaaaacaccttatcacatgctcagtagccatttagttgtcttcttttgtgaagtgcttgatccaactttttgctcattattttcttacccaagcacaagtctggatttgaactctttatccaagtactctatgttgagttctacatgattttaataaaacagtctaattaagtttttcataggtaataatttttgccttttttgaaattctctgtggtgttttcaaaagcagtggttttaaaaggaccattttttcaagagcagcattctatatggcaggaattctgtcttgcatatattatcagaagtaagataaaatcccacagtttggtggttcagatgagatatttgggttcaagccatatgaagttagttttatttacatacctctgatacctcatctataaaatgaggataataataggacctgcctcatagtgttgaggagatcatcggaatagacctacatgaagctctttgggtgatgcctagtacattgaaagccctcattaagtttggctattggtaacattcttggggtgtcatattaggccctcattgtgtccgttaaggttagaacattatccaacacactggggaaacattcacgtgttgatctggaccactcagacataaactgggtggattgggtctgaatctccaggtctagctgtgtgaaatgaccactgaaatgattactgaagcctgttgtaaatgtactttctggtccatctggcttttcagacccaccatatgcctaatggctctgttggtatatgagttaggagggcccatgccaaattatacatattcgtgactggtaaattgttcagtctggctctgggtagaaactaaaagatttaggagggaaagagcagctccctttacaggcagcccaagacacaggagcactttaataaaatagaaacttaggttccacaagaatcatcttgtaaaatctgcagtaacactcctataaaggttatatattccagggcatccaagtggccagagaaagcaagtcaaatgtgacaggagaggaaattgcctaaataagagaacctcctctctgccagtaacttacagggggccatggggtttttctctcattaagtccatctgcctgggctgggtgcctggcagttcttctgctaatgagaatctgctcttcctaatactggaagaaataagtcttcatctctacctctttgcatgtgccagtggcatgtcagaaacaatttttctgtgcatttcaaggcacagctaagtatgattattcagtcacccagctccttggccattggatgcagaggacagagaacagcgctgactgcctgtccttcttctgctgagtcattggatttcagaagggaatcacatcctttatcaatctatgccatcaagatattagcttcccataaatgcttatgtgaaaatgtgcaatgatttgcatctggtcatgatttttttttttttacaatacatcatgttatagctatattaatttcttactattatatatccatatagcatgtaattgtttttattttgcttagtttttttcaactttctacttcctgaattttaagaaattgacacaggaattatttggctcaagggaaaaatagactttgagtccttttgcatattcttattgatcaggtatggtaggcagatttctaaaaatcccttttcccatcaagattacatgcccttttcccctagaaccagtgagctgataagatatcatgtccatgattgcatcatggtatatggtacagttgaccctaaaataggaagatcatctaggtgggccagatctaatcagactatcccctaaaaacagagatatttctggcagaagagaaagtcagagagatttgaagcataagagagattcagctgtggcttgaaaatagcggtaaccacaggagaaggaatgttggcagccttaagggattgaaagaagcccctggatgacagcgatcagggaaacaggtatgttagttgtgtaactgcaaagaactaaattctgccaataataggaataataaccttggaagaggactccaagctccaggtgaaaacacagctggttgatgcattgaattcagcattgtgagacacaaaacactcagccatgatgtgtcagacttccagcctacagaagtgagctgatacatgggtgttgctttacaccactaaatttgtggtgatatgttaggcagcaatagaaaaggaacatacctggtttcttctcattgcattcttttaaatggctgaccagtagatgataattgggtagaaaaaattaaatggcctgagaaatacccggggttagtttgggttatttgaaatcatggggttatttcactagaaagagactccaattgacaccatcatgctcataattattgcaatataattgagacaaggaagaaagaacatcaagtctgccagtgctatcataagagttcaccaggtgctgagtttgacaaccatttttccttcaaatttgaattataccaggaatgttatttgctttttgagctctccttttatatttggtgtatagagtgcttccccattcctgtaacaacataggcaaggttcagtagtgccatgacagctccatcaatgcaatgggaacatgttgacattacatgtctttgtcacaaaatccactattaaaacatacatagcctaggtgtcacaaggtgctagaaaagtggaaggtgggaagtggtgattaaaaatattaaatgatttccagaattacattacaggaaactataatatatggatccagaaatcctggaagagaaacaggatgaaaggatgggtcctgggtgtgtctaacacagagctaaaataagaaactgttgagagagaagaatacacttctctgtcccagcagctcctgggaagagatgtgtaggccttctactctggtgtggtccactcaccttgggctctgctttccatgatgtgccaccaatcttgctggattttctctacactcctgacctcctttgcccttcttctgtggccaggaacagagccctttcagttctcaggataagatttttttcagaaagatttccccataatagtgcccaaatagtgctgttttccaaagcactctcctcaacagaggtcacatctcttgctttgttggatgagtttagatagactagtgggatagtcgaatgaagaaatacagtagttttttttaggaagagggaaactgagggtcatggattttcataaatgaagggggcaatctagatatttagaaaatccctctttcagagactatgctaagctttctaaatattataatagatatattctttacagaaaaaagtgtggttttcatgacctgctacttcaaatgagataagaactatggcattctctacagccaaaatctcaaaataaaaagcccagggtgtcaaatcagggtgatttattttattatccttactcacagtgtttcttttgcctacataagattttagagaatggattttattgctttttttgttcaaattaacatgcttttaataaaactagaaggcttgttctaccaagcaataattttattccctacctaaacgagtggttctaaattatctaaagtattactctgtccttaaacattcttgctagtcaaatgctgatttgagggaaagacaaacagaagaaaataattcagttcagtatcggcttttcagtttgataaaagcaatttctttcctacttgcttatcttctacctttctagtgctgaactctagtactaatcacagcactttaacgggtgttgtaaatgctgttcacggttggatctctgaaaacataatacttaagccttcatcttcaatgtgaagaagaatttggatggtagcacgaataaaattgtggcctgcacaactttactatatggccattaatgagaaatgttggttttaaaaaactgatgtgacttccatgatccatattaatagcataggtaggtaaagatgaacagaaactccatgtttgctctgtgcatggtttgattaattgacttgggtagacaaatgatgattgtagggtggagggtatatatttccttgatttgagccacaaaccctctttacatacagatcaaagtgtctaatacatagtcttcctttccttatactagtaaaggtgagaatttagttgatgctttcatttttctcttctccattcctcatggctgcacatggttcatatttttattgggttctacttcccagtatcttcctctgggatggatcatctatttgtcaacagaaaatgagaaaattatggagaaatgacagtaaactctatgttccctcctttcctctgagctcataattagacaccgtgcccaaatatacgtgcaaatggcagagccatttttcaaagcaaaatactttgaacatagatccaaacaaaacacaactctaaattcattatctcacctctttgcaattaacctaaaggagaaaccagagcaagaacacaccacagctttcggtggagtccacctggggcttgctggacttggtgcatcattagataacttgttttcccacagagtgagatagatgtgccttgaacaataattaaagggctttcatctgttgggttaattaaaactgcccatttgtttgcctattcccatgctttgctgtcttccttgtacaatacctccattgatcctctgtgagctgagaagtatcacaaatttagtctacaaaaaattagctcttctaccttccaacctgactgcatgaatacaccattaaagcacttcctctgaaaaaagtggagacagttggacaatgctccagaagaccatgattaagtagttagggaggggaattacattatcctaagaaataaaaatagccaatttaattgcatgccaattatgtaccaagccctcttctaaaaacgatttctacatattatgttatttaatgcttaacacaaccccatatggtgaagacactgctattatacatgaagaaattaaagcctacagagattaattgtctagacttagactgcatagccagtaagtggcagggacaagatgagaacctagagatttataattctgaagccatgtgcattatggctccattctaggttcctttaattggcacaaaatactgtacttgtattgactgcttacttggtactgggcattgttttgaattctttacctgattaatattttaattaactaatttaatcaaacaacaaatgaggcagggactgttactagcccattttatagtttcataaactgaggtaagagaatctcagtaacttgctatcttcagaaaggacgtatggcagaactagaatttgaattcagaaaatcttgctccaaagactgcacttttaactgctacctctccctgtatcactaaataactaatttgaacctttcttgtgataggaagtcagcaaagtaaacttaatttgaggagccagtctcagtctcataccagtccagtggacttgaaagaggataactgggatgtgcaggtagacatacgatagagaagacttagggtgatatagtccagaggtgggagtttaacaaaggtagagagaatcaattagtggagaaaggtatgtatcccagtggcaataatttcacagctttacctagggaggcacgatcttttaattgtgttaaaaataagaagtgacagtttactctgggcttccactttcccttcttgccgtatgtgtcccaggaccttgtaaaagacagtgacaaccaccttggggcagggctttacaactgcaaaacctgattaaatcaagcaaaataggtcaacattccgccttcatattagctgtacagagcctgacacggggaagcatgaacagatgttgggcagtgcacagagggatccaaaagcatctaattaaacacagagaaaagtgcagaaggaaccaggagagttacaagctcagggctcaccttggtacagggagattcaggagccaagagccattggaagtaacaccaatgtgggtgccccagaacacatttgtcccaaacatttgtcttcagctgtggggctgacagatgcatgaatttaagctaaagactgatttcaatcatgcttataagagtttgtataacatgttaaatttacaaatgactttcccatccattgtattattaatttccagagcagccttcaaagacaggcaggagtagatctcctttacaaaggaggcaattaagggtccaagctctactaccagtgcttggcagtaccagagtcggaatccatttcttataactcccagtctgtgtatacataaggctgaacagggcaatgtggagaaagggaaaacaggagaccaatgggaccctgctaatagaggaaaacatgctacaagtcaggagaatgggtattaagagaaaaatggtgagaagctaaggaaaaacaccatttattttatttaaggtaaagatggatggatatttgtggttatgtagatgaagaagcattcacatttatgtggtcatttatctagtcagatcatgggaaggtacataaaagtggtggcttttgagatggctatgatattcttagggagaaatgaagtagagagaattccaaggtgaaagagatagcttgaatgaatgtaaaaacgtagaaattaagggcatagatgaagaaaaatgaattgtccactttaagtgttgcaatggatatgtaaaaggaaatagtgaaaaacaaagctggaaaggttggaggataatatcatagaatcctttaaatgccaggctaaatagtctgatcttaattcattaggctttgaaaagccaacattagtttacaacatggaagtaacacaatgtctgcctcatgaaattcttgtgagattttaatgagaagttgatgcaaaaatgctttgtaaaaatatttaataaattaatataattgtattcctttgtttatgtaacaagtacttattgagagtctgttatttattaggcatggtctaggcattttacataaacaaataagacttatcactatgcattgaagcttacagtctagtggggaaaatgaacatttaaataaataatcacgtactctaaggtaagtgtacatatgatattatgaaaatacagagggtttgatgaactcttcctggaagaatcacatgggaaatgatatttgaaataaatcttgaataaacatagatctaaataaagtagctaaaattattaacttctagaagaaaacagcagggaaaatctctgagacattgggttagagaaagtcttctcagatcacaaaaacacaaaccattaaaaaatgataaaatagactttattaaaattaaactaacatttaagaaaatgcaaaagcaagccatatacttggagaagatatttgtaagacacataactgaacagaacgcttatatccgaaacacaaaaaagagctcttaaaaacaatgggccaaaaaatttcaacagaccctgccaaagaaggtatacaaatggccaatttagcctaatttaacttaaatttaacaatttaatgctcaacatcattagtactaggttaatgcaaaataaaatcatgagatatcattatacacctactagaatggttaaagtttaaaagaatgattaatgttggtgagaatgtggagcaactgaaatcctcatgcacttctggtggaaatgcaaaatgtttaaaaataatgtggtagcgaattataaaattaaaaaatatggctgggcgcagtggctcatgcctgtaatcccagcactttgcaaggccgaggcgggcgaatcacaaggtcaagagatcgagaccatcctggccaacacggtgaaaccccgtctctactaaaaatacaaaaattagctgggcgtggtggcacgtgcctgtagtcccaactattcgggaggctgaggcaggagaatcgcttgaacccaggaggcggaggttgcagtgagccgagatcgcgccactgcactccagcctgatgacagagtgagactccgttttttaaaaaaaaaaaaaattaaaatatacttaccatgtaacacaatgatcctattcctaggtatttacccaagagatattaaaatatacatctacacagagacttgtatatgaatgttcagagtagtaatttttacaatattcccaaatacacaacccaaattccatcagtagtaggatgagtatgaatactgtagtgtatctatactatgaactttaagagtataaggactggtggtgatcattaaatatatgtgtacctatagaactaaaactaaattatggctataaagaagaaaacatagtagataatggctttatgttctgacaatgcagatacagtacatctagcaagaattagagatggagaagaataaactcatgaccttgtaatttaaaaaagttaggccactttaaattaattgtatttttaatgttgagagattaaaataacttttaaagtaaataaagtccaagacgcaatacatgatatttcttcctaatatttaagttttctctgacctgcctaatctgactccaaatattcctaagtcttcttccctacctctcatcaggatacatggatttttactgcttactctaaaaaacatggagtttaaaaatgttaagcagatataaaatgattttctaaaagttgatcattaaaacacttcattgttctgaattagttgacaactatgaaatgattgttcaatgcaaaaattctaggtaagccaaaaaactaccaagttacagattcatatgacaaataatattcaagcccaggtagtattgtgttgcatacattaaagcttaataggaatattttagtttctgattatcacaggactactgaactaatcatcttcaataattaataaaacattggtgcgaggaaaacaaaatctaaacacaccataattactatagggaaatctttgatgcaatattacaatatataataaataacaattttgaaagctttttaaaactgtgttttaatcacgtttgcctccattaagctgctaagttaattaaataggcaaaccaacttgagacaaggaaattgattttctacataggacactctcaacagagtagcagacataagaaaacgatcaatttttcttcatggtgtgcaaattaagttctgttcagaaaaaaaaaaacaaaatccctgtttccttgttctcttctgctcttttgttctttagtgacaggttaatcaaataaatatggcaggaagggaaaatacatctgaatattccctgtacctttcactttcgggaagtctctagtgtcagagagagcttccaaccactccttccagcctcctctctaacaaagcctgggcacccaggctttctacccattgagaaattctagcagcaatctatttaccatggaccaaaaaaaatgtaacttgtgcattgcaatttttaattataatagacagtctattcctttgtcttccctttcatcacaatttcccccatctccacacctttcccaggtgcacaagggtcttactttcatttgcatcccaaaagagaaatcaggaggatccacatttgcctgtatttataaggctagagaaagcttaactgtggcatcccaagcttgaactctctgacatgggattttattgttttaaggacttcatcaatgtccacttataatctggaataagtgaatggagggatctttgctttgatgcataaaaatcaaaagaatatccctttgtgaattctgatgctgaaaatgtgttcttgtttggagggtagaaaaggggaattttcctatgtcctttgcttattatgacattagtaaagatcgctatagtccagaacatatatgtcaacagtccaactatcatagtgtagtattcgctgtagtgtgccatctctgagataattttgtacaaacatgaatatattttttactcttttgttgaatgtgaaccacaccaagacatttatcacttgcaaaagaacttgtagggcttcatgagggaagaatttttgaatacataaaattcaagcaggagctttaaataattccagaaaactgttttcccatactttgtaattccaaagctggggataggaagcagtgtagtttttttagatgtaaatatctgagttgtgagaaatttcaaagtaaaattgatattacattattatataattattataatatacagtcatgtaccacacaatgagctttttggtcaacgatgaaccacatatacaatggcagtcccataaaagcatagtactgtatttttaccatgtgttttctatgtttaggtatgtttagatatacaaatagttaccattatgttacagttgcctacagcattcagtaaagtaacatgctgtacaagtttgtagcctaagaactataagatatgccatatagcctagatgggtagtaggctatacagtctaggtttctataagtacaatctataatgcttgcacttcaaaattgtctaacaacacattttgcagaatgtatccccattgttaggtgacatgtgattgtatatagcctaatgccatgttattatatccagatatcccccagtaaaatcagatctattatgaaataaatgtttgtgtctcaccaagatttcttgttgaaaccctaacctccaatgcgacggtatttgaagatggggccctttgggaggtaattaggttgagatgaggtcataagagcagggctctcataatggaattagtgcctttgtaagaaaagacaccagaaagcttacttgctctctttctctccctccccatatgagcacacaatgagaaagcagccattcacaagccaggaagaggaccctcaacagaacctgaccgtgctgggaccttgatcccagactttcagcttcccgaactgtaaaagaatgattttctgttgtttaacacacaagctatggtgtttaattatggcagtcagagctgacaaaggcactaacttagaacatattcaactaactttgcttagtgtgctttacctagactgtcatctagccactgctttgcttgtctgagcagaaactgagtcaggggattaccggacataagtaagggcagaaaatcatcctggtgtccttgacacagcagaataacattgtttttgttgtccctctgcatttctctccacatatataggcgtatctcattttactgaactttattgcatttcacagctattgcattttctacaaattgaagatttgtcgcaaccctgcaccaagcaagtctataagcaccccttttcccacagcatgtgctcactttttctctgtgtcatattttagtaattctcacagtatttcaaacttgttcattattgttatgtctgttatggtgatttgtgatcagtgatctttgattttactattataattttttgggggtaccaggaaccatgcccatataagatggtaacttaattgatcaatgttgtgtgtgttctcacttctctatgaaccagctgtcccccagtctctctccctctcctcaagcttccctataccctgagacacagcaatattgaaattaggccaattaataaccctacaatggtctacatgtttaagtgaaaggaagagttgcacatctctcactttaaatcaaaagctagaaatgattaagcttagtaaggaacgtaagtaaaaattcagaataggttgaaagctaggcctcttgtgccaaacagtcaagatgtgaatacaaagaaaaagttattgaaagaaattaaaagtgctactccagggaacacctaaatgaatatttaggctcactgttgagatccactgctcagaaaaaaaaaaagattcttttcaaaatattactggtcattgacaatgtacctggtcacccaagagctcttatggagaggtacaagtagattaacatttttttttaatgcctgctaatacaacatccattctgcagccaatggatcaaagagtattttcaactttcaattcttactattttttaaaaaatgaatttcataagactatagctaccatagacagtgattcttccaatggatctgggcaaagtaaattgaaaaccttctggaaaggatttaccattctagatgccattaagaacatctgtgattcatggaaggaggtcaaaatatccacattatcaggagtttggaaaaagttgattctaaccctcatggatgactttgaggggtctgagacttcagtggaggaattcactgcaggtgtggtggaaatagcaagaaaactagaattagatgtggagcctaaaggtgtgactgaattgctgcaatctcatagtaaagtctgaatagatgaggagttgatgaagaaaggaagtggtttcttaagatgcagtctacatcctggtgaagatactgtgaacattgttgcaacaacaaaggatttagaatattccataaacttagttgataaagcagtggcaggagttgagaggattgaatccaattttgaaagaagttccactgtgggtaaaatgctatcaaacagcatcacatgatacagagaaatctttcgtaaaaggaagagtgaatcaacacagcaaactacatggttgtcttatttaaagaaattgccagctgggcacagtggctcatgcctgtaatcccagcgaattgggaggctaagtagggaggatcacttgaggccagaagtttgagacaagcctgggcaacatagcaagactgtgtctttacaaaaagtttgaaaataagccaggcatggtggtgtgcccctatattcctagctactggaaagactgaggcagaaggattgcttgagcccaggaagtcaaggctgcagtgaactatgatcgtaccactgcactccaccctgagtgacagaatgagaccctgtctcttaaagaaacaaaacaaaacaaaaatcactgaaattaccactgtcacccaaccttcagcaaccaccaccctaagcagtcagcagccatcaatgtcaagacaagaccacatcacaccctctaccagcaaaaagattacaactcactgaaggctcagatgattgttagtattttttagccatgaagtatttttaaattaaggtatgtacattgttttttagacataatgttattacattgtgctatgttttagacataatgctatgtctaaaattttagacatttttagacataatgctattgcatattgctattgcacacttattagactataacttttatatgcaccaaggtaccaaaaagtttgactcacttttttgcaatattcactttattgcagtggtctgaaccaaacccacaatatttctgaggtatgcctgtagttagcatgtgggcatgttttctatcactaatgcattttaattctctgaaatcagtatccacctctagtgaacttatatttaaactcagtgccctaagcatgatggatactgaaatatttttggttgaaggacatggtagcctggattttcagagtagttgtattagtccattttcacactgctgataaagacatacccaagactgggtaatttataaagaaaaagaggtttaatggactcacagttccacatggctggggaggcctcacaatcatggtagtaggtgaaaggcacatctcacatggcagcagacaagagaaagaatgagaaccaagagaaaggggtttccccttataaaactatcagatcttgtgagacttattcactaccacgagaacagtatgggggaaactgcccccatgattcaattatctcccactgggtccctcccataacatgtgggaattatgggagctacaattcaagatgagatttgagtggggacacagccaaaccatatcaacagtattccaaaatggaggagagggagagctgtttggattagaaaataataataataagccaggtgtaatatagacactgagcagagactgcttgcacatggggacttctctaaagatggaagtaagtgattacttgggtaaatcacagaatcctgaaatttcattctgcaaatatggagaagttaggtaaaaaacaaactaggtgagatggaggcaagctaggttgtttggagcatctgtggagcacagagctgggtgtctgccaaggttctctattatctttgcagtggtgggttcctgttctccccactgtaatctgggcgaggtcacctgtaacaggcttaacttcatttttgttcagccactcctgaattacttccttctgtagacttggaaaggttatggccagattatgttctccatgttaaatctctgttattcttgatgaaaataatccaaactgagggttcctgcacaaactccccatctgactctttgatgtccactgttccctagagaaatgtgaagttggctcctgcagctgcacttttggatttgttccattctcagaataggcccagaaggatgtttctacagcttggtacttattctcagctcttagaatattttcttaattgcttccctccgcatcctcccagcacttgtgagctatgcttccactgggcttcgttgcctgcatttgtacattgttggtttcccattttttccccaaatatgatgtaacctccctattaagtatggggtctttgccatgagtccatctgtgttgtaatgtggctctctgtacttatttcataactatgcaaatacttttttttctaacccaggtcacttacactctagaacctccccattcaaagtgtgatccacaaaccagcataggcataacctgggaacttactggaaatgtaggatctcagtccctgtcccagacctactgcatcacaatctgaaatttaacaagatcctcaggtgattcaggtgcatattacaatttgaaatacgctgggctacagtggtggtttttgaagctggttgtacagtagtcacatggagaacttctaaaaaaatatcaaagttgggtcccactcctagggattctaatttaattgatttgaggcagggccctaatatggatattattttcaagttttatatttgttccatatttacttcatttcacagctgaaacacactttcctagaataagcaatattaggtgaaatttgtgcccttttagctgtacatgttgtatattctgtgttagactagaagatccttgaaggccacttccacattttctatgttttgtgaatcctccaaatcatccttggtatggtgttaagtgtataatcattgttcaatgacatgttcatggttgatggggtactaaagcaggggggagatgactagcatttatgtcctggccctgtaagccatgacctctttgaccctgagcagatcacttaaacctctcagaagtcaatgtttttgttcagtcaaatgtgaatgacttctaactctagtagttattcagtcattcattcacataataaatgtgtatgaacatctgttctttaacagctactgttctaggcactgaggagatagtggtcaacagccaagacagaaaaagcctttgtcctcatagaacttataatgggagatataaataacaagcaaataaataaaaatatgaagcaggatagaggcataggtagtaataagtgctaagaagaaaaatagagcacagttaagtgttggagcgtggtaaattgttaggtgacagtggggagactttatttaactaggttatcacagaagacctttctgaagaggggacatttgagcagagacttgaatggtgtaacaggaaagctaggcaaagatctgggggcaggaaagatctttctaagcagacagcctccaataatagaagtcctgggtcagaaacaagctaatgatggtcaagcgctagacaaagagcaagggtggttgtagtagcattctttgtggatgtctctagtctatgacttaaaggatccgtatttaagtcttaaaagtatcaaagctttagagcacttatgggaaacataaatcacctgcaggcataaatgcccaatattggggcagcacaaaagtaacagaaaccaagagtgtcatcatcattggctcaacttctgtactttccaatatagtaatattttactttaggatcagcaggatcgtgagaccaaacacatacagagataatatttacttctctaggcagtgccttgagttcagcaaatttactcctgctctcttgtgtgatgtaaaggtccatttaggcactctcctgcttctgtctcttcccctttgagtgaactgctcagaaaacagggatcagcacaaagagccagccctctgggcatggtgtcctgggtgttggggcatggctctgattccaaactgtttgagtctctggttccagccaaggggctgagtggcattaattttgttgctctcttgcttcttgaaccattttgtttcagatatcatggttttatttctacagttcagctgccaaagtccatctagggtccatagatttgtgtcccaattatagaaaccttaattgcaaaatcttgaagttaaaatatcagccctcaaaggaacaatgcttgatgatgatgattggtgatgatgatgattatgagtaatgtaaccataatgggtctcctctttttcacatgtcatttgactctggcaatgcacattaaacatttataatataacaacatggacttacacaaaataactttaattctatttcatctctcttctaattaccttatatgtattatcaaattcgatcccccttctgtattaggcactgtcttcattaccaggaaactgagtcacatagacattaggcaacttgtccaaagttatacacttaaccaggcctcaaaccccagcatttctgattccaaagcttgagttcatagtcatattgcatatcttcctgagaaataaccacttattttacaaaattcggctcaagaatctactctcaatgaaactttctcttacctgcccctcatcaggtatacacactatgacaaagactatattattatcattttcagttcttattctgtgtcaagctctgtgcttggtgttgtgcttgtgtaacccttataaagttaggctgcctcctggccatgcaataaaatggttttattcaaagtcctatactgtaaaattaaatcgttttcgtctttattgcattatctttaaaaagtccagaaagataatagtattcataacacagaacaacacttctgataatctttctctccctttgtcctcatcctccctcatcataagcaatgcatgagagctgtatccaatcccacttcttccaaactctaaaaatctttcctcaaaactcattccaggtttgatttgctcctctgtctcttcctcgtttccttctttcctcctttttctttccaaatctagtttattttttctccctacagtagttttgtatcctttctagtgtaaataaatctactgtgtcttaagcttcttcacactggcagttctacacacccaatgagatgaaagctgaatcaaccaacctcatcaaacaggcagccctagcaacaaaggaaccttagaagaaaaaagaaaaggcaatggccattcatatgtttatattttccccttgtcatatatatattcttatctatcatcaccactcttaaatggctttaagtttttgccatcttaagatgaaaaattgaggatcagagacggttatctcttacccaaagtgatagggtaaatgaatacaaatccagaatatgaacctactctgagtaaataaaagcccctgagtttagccagactagttattggatgtgttgcctaatctcttcactctgccttaaaggctccagtgtcctctatagcaggggtcagtgagctatggcccatgagccaaatccagcccactacctgtttttgcaaataaagttttattggaacatagtcacactcattcatttacatacatctatggctgcttttgcactacaaaggcagagttgagtagttctgacaaaggctgtattgctctcttaacttaaaatgcttactgtatggctttttacagaaagtttgctgactccagctctagaagaccctcatagcacctcttacagttaaccagaaacaggccaattcaccaaaaatctatttgtagattatttatgacatttaccatactatatttaccaatctaacaaaaatatatttatttgaactacttataggatttaaagcaatttgtgttgggtgaaattaacagcttttgaatcattctgcaaaggtttctttgcttggttcttatgttgttttcttaattaatatgtcagtgatgctcagtttctcattgcccttgcatcctgctgagttagctggagggtttggggtagagaaaggggaccctgagtctgggggaaggcagagagaagagccattttagagcacatcctgggctgccatcaagaggagtgaacctgggagaaagaaggagaaaggccaagcacaggaagataggagaccctgcagctgggggcgagtatgacagcccagaactctggattctagctactcacaacattaatgagtgagtcctactatcacatccaatactaatttctgtcaacctacaaatagttttaaaataatttggtaatttgataaatttgttcaatatgacacgcagatcattcagtggatttatctgttgcaaattgggttctggcaaatcgttttagttaacaagttcatcaagaaatgtttatggggcatctactatgtgccaagtacccttgggatttaccagtcaaaatttaaagacctccgtaatcttcttataggttatattccatcagggggagacagataataagtaatatatacaacaaataagcaaattatatggcactttagaaagagttaagtgctgttggggggcaggaaagaatcaatagtgtaatgaagattgagactacaaatggaggaatacaattttaaatagtatggtcagggtaggcctgattgagaagataatatttgagcaaagacttgatggagtgaggagaaaggcacatagacgtctgggaaagaacattccaggcagaggaaacagtcagtgcagaaactctacggtgaaagcaacaaagaggacagtgtgtctggagtagaaagtgaagggagaattagaaaatgaggtcaaagtaattatggtggatggaccatgtaggtccttgttgaccactgaaaggattccagcttacatactaggtgaaatgtgggccatggaggtttttggacaaagaagctgcatggtatgacttaggttttaaaaaggatactgcagctgctttgttgattatagactgtgggtgaacaagggagggagcaaggataccagttaggagattattgaagttatcaaagcgagagatggagattgggaccggtggctagcagtggagagatgagaaagggtcagattttgctgcatgtacattgaagtagggccaacagaacttcctgatggattggatatgggatttaaatgaaataaagtagttaaatgttttgcgtagtaactggaatgatggagttagcgcctacttgaccatgagaaagactgcgattagaacaggttaatgtagacagctatgagacatcaaagtagagtcagtgaataggcatttgatataggagtgtggagttaatagaaggttttggctaaagatacaaatttcactgattgaaatacagctcctggcatttctttgtttcgtttactagactgtaaattatttcatggcaagagcctgtctcattcatttatctccagcccttaacatggtgccagaaacataataacactgtgttttgctgatgttcaaagatgctacatgaatgaatgaatgaatgaatgaatgaatgaacagacacatacttttatgacgctaacttacttatgcactttgagacaagaacattttcctcctgtggaaggaaaaagacttcaagttgtttcatttacctctaatggtatttagaaagcttgcatgttcaagcaggtatcatagtaaaggatcaaatatggactttgaacttggcagtgtgctatcttttccatcatttaagttgtaggaagagataatacatatattgacagtccaagttattcttgctttaagaggatgactcatattgatcaaagaagagttgtcaatttctagacaagctggatgatcagagtaactaaagtctaaagtaaaaggtcaggaatattcatccatctgagaaaaaaaaatgtatagctgacagactaagacaagagaaaaataataacttctaggaagtagataactttattatagcttaatttaaaagtagaaaatggctgggtgtggtggctgaggcctgtaatcccagcactttgggaggccaaggcaggtggattgcctgagctcaggagttcgaaaccagcctgggcaacacggcaaaaccctgtctctactaaaaatatgaacaattagctgggtgtggtggtaggcgcctgtaatcctagctactcgggaggctgaggcaggagaatcacttgaacctgggaggtggaggtttcagtgagccaagattgtgccactatactccagcctgggtgacagagtgagactctgtctcagaaaaaaaaaaaaaaaaaagtagaaaacatttgccaatatcatccacagtctaagaattaagtatatttttgcagcttactaataaatttttgaggttcataatatctcaagcctatgatgtattcaaagtagcaactctgcccaaataaatatactaatataaatatttttatcaattttaatttccagctcctatttaagaaagggaatggaatagtttggtagatagaactgatgtatcaggacaccgagatttattattttcctgaatattaccaagtttgttactataattccttctgttgagttgtgacaaatgagaataaattatacattttcagatctgttcctttgcaattcataaagcagaataaaacacacacacacacacactcttacatatacacagatacctattaataaaaattcatgatcaacaaggcagttttatttaaaggagcagatataacttgatttcagagttgcagaaagcttggctcacatttttttacattaatttcagtatatattactgcacagaaagatgagcaacactattttcttaagctaactcatttttaaaactgtaatttcagatgtgaatgatgatagaaagcagagaaattatcctgataagcattccaggctccaaacaaaatatatatgaatgttcaggctttaaaggtttaggcacacatgagttataaaaatatttatttaattttctgaacaagaatagatttacatgaatgctatatatgatttgttttaaagtcttccctgaccacatatactatgggcacagtacctaagtttgcatctctgtcaacaggcaaacaatttatatatttattaccaacacattacagttacaaagttaacttataaaaggattaaaacataggatactgaacttttctatgacagagcacggaatgtcttttcatttgttcaaatcaacttttgtgttcttgcacatttcctgttaagtttattcataaatattttattatttttctgttgctattgttatttttcattatattttgtatgaataaaagttattaatttccacatattaattttgtattttactactttactgaactctctaaatatttatactagtagtagtagatttttcagttggttctcttgagttttccagatagactgtcatatcattcacaagtagctaccatgttaccatctcctttctaatttgtatacctttagttatttttcctaagtgccttaatgtctaccttgagtacaatgttgcataataatgctaatgtaggtatccctgtcttgttcctggtactagtcataattctatatttccccattaaacatagttttggcttttgtatatatattttccctgaattagtattattaaagattttcatgaagaatttaggttgaatgttgcaaaatctgtttagcatatcagtagctgatcatataatttttgcattagattccaggcgcagatggattcatagaagacttctagtataccttgaaaaagtagatgatgctaatttgttttgtcaattccagaacctaatgtatgaaagaaaaacttctaaatcataaagcaagcataacaatcatgccaaaattactagaaaagattacacacacacacacacacacacacaaaataactgaagacaagtctcacttaggaaaatggatgtaaaaatgctatgtagcaaacaattcagctagaaatttaaaaataagttatgaccaagtacgatttatttaataatgcaacgataatttattataagaaaatctattactaaaatatttcatgttaatttatctaaggagaaaaatcatatggctaaatgctgaaaactgtagcccttgaaaaaatttttctagggaaatgggctacttagattttttaaaaatatctcctcagtttcagtaaagtatatttttctacaaaactgtccatttcatcctgattttccaatgtatatgtataagttaaagtagtctcttaagagtcttttaattttctgtgttctttcccattattgtttcttattttatatagctatattttctctctttcttgattagtctagcagtttagtttatttaaaaagctagttcttcattgtatttattattcagctaatattcttttttaactcattaactcctgcttttatctttattaattcctttattctattttcccctagtccattttgttgtttactgataaaaatattaaatctcattctgagtatgtctctagataggtcatataaattgtggtataaattgctttattactattttgtagacactgtgcaatttcagcttgtatttcttctttggttcaaggactaagaaattcatgctttccccagaaagcaaaatctttttatttcctacattttgttgttttatttttagttttatcacattatgggaaaatatttgctatattgtttttaatttttgaagtttattgagattgtctttgcagtctagtacatggttgatttttatgaatattctatgggtacttgcaaagaaggcatattctttatttacagaattcagaaaataccggttagattttccgtgttgcttatgttacttagatcttccatttgatctcccttcagctgtcagcttactagagatttccatagatattttctcaaacttgcacaacctgaggccagatgatctccttttctctgcttttctagcacctgtacttcctgctactttaacaattcttgcattgcattataatttacttgtccatacattcaaggtccttgaaaacaggacctgacagctgttagcacatagaatgacctcaaaatcatttgttgaatgaatggatgagtattttataactttctcccatttagaatttctctttaaagagaaggctggaggggaggggtcagggaaggagacactgggaagaaaatattatagatacattggaggtgtccggcaaatggaaaatcttccaaacaagttctataattctcagtcagacactggcagcctaacacattggtactcagatatggatcagtagcacgccatcagcccaactgcaacaggaaaaatggcaaatgggccagtgttcatcaccagcattacctatttccctaattttgtaccctgcctctgaagacaccactaatctcatattattattctggcttcaatgtttagaaacttcctcagtccttttctcccttttgcaatgaaaattccaattaggccagtctcagttgagtattggttttattaaagtaacttgcaaggagttgtgactgactctatcaacttaatttttcagggcatattttctttgccaaatgggagcctgctaatctaaatacatcttctgaatagctcttccactttcatgcctaatcatactttgtgaatgcatggaatcagcatagtttattggaggcggccatatacaatcttgccctttccctttcgtttcctcatctgaaaaatgataaattccattagctgatttagaaagttgtctcagctctgaagttctggcatttagcctttgtaaattattttaaataaccccaatcaccattggagaattgctgagggtaagcaaggcaaatattgaattcataataaatcctcaaacggcagatggcatggtggaggggatgtatagtcagtctttgaccatccacagcactgaggtatggcacaaatcatcttaacagtggataatacagaaataggttatcaatgatcaaagacaaagaatggagaaaggcctaagagatcatctggtccatgtcctttccatagacataaatcccctgggaaaaggtagtgtaggttaatcaaatattcttattaattgctaggtgcaagataccaggaaaactaatgctgaaagaattagagtaaaataaaagatattccaagtggtaaaactagaatgagtatgtgatgtcacagtggaaataaagctggaccaagaatctagctccaggcttggtttttctcttaactggttctttgagattgggaaaatctctcaagctctctgacctcagtatttgcacaagtattgtatgtagagatagaatgagttatatattaactttttgaaaaattagtttatcctacacaaaatacataataattgttcacagtgacaatgtgcttcatgtgagagaaaatcaggcaaaatgatacaaacttggtattttcataatgttactcattaatgaaaagccttcattatcaccactatgagtcataacactggataaagctcaacaaatgtttatggtaaaaatcaaattcaattatgcattataaaagcataaatggatctctagcatttgagagactatacagttgatatacagtttatccaaaattccatggaaataattttgcctggctttctgaaaattaataattaatagttttagatgtaaaggtaaaactgagctgtttcaaaccaaacagtaattttaaagcaagaattgtagcaggaaagttagcccctctctgatagcattgatgtcaagaaacagcagttttcccatatctcttaagtgctactatccaggaagaagtcacacaagaatgactcccacgtttaactttaatgaagatcctaaattggatgaaactattaattaatctaactaatttgcagcactcagggcattgattctaatggccggatagaagtataaaaggtaattccaccatgatgatgagagttaacatgtttgagcatttacaaggtaccaggcccagttctaaagcactacctacttgttatttcacagatatctcaatacttacagcaaacctattaggtgggctccattattatcctcatttttcagctgagaaaactgaagcacagagtcattaagtattgtgtccaaactgtacagctaggaagaggcaagacaggatttagaccctcaaagtccaatactagtgcttacagggtttatcaccactctaactcagcactgatagagtgcaagtcaatcatctattctcttgtatttatttacctctgtaaaacagattacacaagggcaggaaccaaatgttaatcatctttgtatacttctcagcatttcacacacaaggaacagtctacggtgatttgttgacttattgctgaaaatatgcaattcattttggggccccatatctgtgtatacaatgacaagtggaaattgagatgagaatttatttaagtgattccgtaataaacccttacaattaaatgttttaagatatgaattatccagttttactttttatgatcattaaaattagagaaaatttgttgattcagactatattaggtaatgattagcttgaattaaaatataggattaaagcagtaattcataatactttttttctataaagagataaatagataacattttaggctttctgggcttaaagttctctgttgcagctactcaactctaccatggtaagtgggcactagagagccatagagaatatgtaaatgaatgggtatggctttgttctaattaaactgtatttgcaaaagcaagtagcagaacagatttaactgatggacagtagtttgatgactcctggacttcagcttaggtaaactgattttgaatagctacttttatacatgttcaagcatggagcctacttgaatggatagattaaaaatgaatatattatggtttttcttctcttatactgattaattatcctcccagataccttgcttattatttttaaactgaacttttctctttaaatagtaaagaaaaaaaaatcaaatttttccaaattctggattcatgaggcccaaaataagcaacttatctcccttttctcatcttttttatctatctatatttctttctctctcctccacaacaaagataacatatattaactgtcaattgctgcataacaaatttctgccagattttagtggcttaaacaatattttaatcttacagtttttatgagcatttttatcttgtagtttctatgggttaggaatccaggcacaactcagctggaacctctctttcagagtctcccacaaggctgaaatctcacatgatttcatagccaaggctgtagtctcacatgaaggctcaactagagaaggatctacttccaaagctcactcatatagttgttggcaagattcagttcctcctgtgctgtcagactgaggcctcagctcttcactggctattggctgaatgctaccctcagttccttgctaggtagccctctccacaaaggcaacatgagaagagccagcaagagagtgccagcacgaaagaaagtgcaagcaagatggaaggcagtcttttataacctaattgtggaagtaacatcccatcaattttgacacattgtatttgttagaaacaagtcagtaggtcagcccatagtcaaggggagcagattatccaagcacatgaataccaagagacacgaatcattggggcccattttagaaggctgcctaccacacactattttaataaaactaactctgcattggtcttttagtgtaatgctgtttgtattagtccgttttcacactgctgacaaagacatactgaagactgggcaatttacaaaagaaagaggtttaattgacttacagttccatgtggcaggggaggcttcacagccatggcagaagatgaaaggcacgtctcacatggcagcagacaagagaagagagcttgtgcagggagacttccatttttaaaatcatcacatgtcgtgagacttatttactatcatgagaatagcacgggaaagacctgcccccatgattcaattacctcccactgggtccctcccacaacacgtggaaattcaagatgaaatttttggtggggagacagccaaaccatatcattctgcccctagcccctctaaatctcatgtcctcacatttcaaaaccaatcatgccttcccaacagtcccccaaagtcttaactcatttcaccattaactcaaaagtccacagtccaaagtctcatctgagacaaggcaagttccttccacctatgagcctgtaaaatcaaaaacaagttagttacttcctagatacaatcgggatacaggcattgggcaaatacagccattccaaatgggaaaaattggtcaaaacaaaggggctacaggccccatgcaagtccaaaattcagcagggcagtcaaatcttaaagccccaaaatgatctcctttgactccatgtctcacatccaggtgactctgatgcaagagatgggttcccatggtctcaggcagctctgcccctgtggatttgcaaggtacagcctccctcctggctattttcacaggctggcattgaatgtctgcagcttttccaggtgtacagtacaagctgtcagtggagctatcattctggggtcggaaggacggtggccctcttctcacaggtgcactaggtggtgtctcagtagggactctgtgtgggggctcccaacccacatttcacttcttcactgccctagcagaggttctccatgagaacatcaaccctacagcaaacttctgcttgggcatccaggtgtttctatacctcttctgaaatctaggttcccaaacctcagttcttgacttttgtacactcacaggttcaacaccacgtggaagctgccaaggcttgaggcttgcaccctctgaagccacagcctgagctctatgttggcccctttcagccacagctggaatggctgggatgcaggtcaccaagtcccaaggctgcatgctgcaaacagcacagggaccccaggcccaacccatgaaaccacattttcctcctaggcctctgggcctgtgatgggaggggctgctgcaaaggtctccaacatgccctggagacattttcttcattgtcttggtgattaatatttggcccctcgacttatgcagatttctgcagacagcttgaatttctcctcagaaaatgggatttacttttctattgcattgtcaggctgcaaattttccaaacttttatgctgtttcccttttgaaactgaatgcctttaaccacaccgaagtcacctcttgaatgctttgctgcttagaaatttcttctacaagataccctaaatcatctctctcaagttcaaagttccacaaatctctaggccaggggcaaaatgcctccagtctctttgctaaaacataataagagtcacctttgctctggttcccaacaagtttcttatctccacctgagatcacctcagcctggaccttattgttcatatcactatcggcatttttgtcaaagccattcaacaagtctctaggaagttccaaactttcctatattttcctgtcttctgagccctccaaactgttccaacctctgcctgttacccagttgcaaagtcacttccatatttttggctatcttttcagcaataccccactctattgtaccagtttactgtattagtttgttttcacactgctgataaagacatatctaagactgggcaatttagaaaagaaagaggtttaatggacttatagtcccacgtggctggggaggcctcacaatcatggtggaaggcaaggagaagcaagtcacatcttatgtggacggcagcaggcaaaagagagcttgtgcagagaaactctcatttttaaaaccaccagatctcgcgagacttattcactatcatgacaacagcacgggaaagacctgcccccatgattcaattacctcccaccaggtccctcccataacacatggaaatttaagataagatttgggtggggacacagccaaaccatatcactgttaaaacctttaactaactgatgtcctgtcaacaggagtaatttgtactttcgtaatatccacatccttataggctcaaaatgtaactgtgactctgtcctcctaaggagctcagggtgggacagattatttatataacatttctgcaaataaggtgctctcattatctgaccccaggagagttggcatatgctgaatgattctcgcacagtattagacaggaaatactagtttctgtttcagctccattattctaattttataaatttaaaactagctgtgcagagcaaaaagggaagtgataggtgttaaatcatatgggcaatataggtcctaaattgatttggtacttactgcttgaagaatgttttttgattcatgtcaacactccattcttactggtgatgggcaagccagccaggcataggatatttgctagtaagaaaaaaattttcaggatgtgtttctttgctatcctggttctaaatggcaatgatgtggcaggcatcatttttgtgataggctctcctgatctaatttggggtttgagtcatttgtttcagtaaactgcagaccctgtgacaagcatttggatgcagtttatttgaaagatggtgacaagaaagacaagagagaatgtggaatgtaaatagtgaaaagagaaaaggcaaacaagtgtattattgagttggttaccatgagggacaactagtgttcaattatgctagggatcctccaaaaactgtgtagaattctcttcagattgccccaacaagtaccaggaaatccagggtctttatccaccaacccccatccttccatggttgaggactgcccctggtagtgttctaggcttccttgcatgcatgtcaagaaagtttccaaggtaccagagaaatctcttaggcagaaaagcagagcttggggtgagttgctgagggtttatgtgagaattgtccattgaatctgcaagtaaactcagtgtatctgctatgcacatagtattgcacatgcaattgtttttcctgaattagtactatttgcttctaagcaaggaattcactattttaggcaagtcttgcctggcacatagaggcattcaatgaatagacattatcagatgatactgaaagtgctaagaatgcagagtagagggcctgaaggctgttactgggactcacagctctgatcaccttgacattgggaacccatactgctattgatgtggtttcctctctcatcactttttatttcccttgagtcacagaatcttagaatagcagaacccttgaaaattatcagcccgatccttttatatcccaagtgggagtgtgagaccccaaatcgtgagataatgtgcccaaatttgcaatgtgagccagtggcaaagctgaggtccacatttttggcatcttctcatggctctctctaacacagccttgctgctttctcttactttagatagtcatactggattgatttccgccaaggggctgagattgatctaaactttctgaagcagatgtatgcaactgatatgttagaaactgaggcactcaatgagcccaaccaaaatattttcacacttacactttatcttttaagcattctgtacacttccatattgaaaaataataatgctatctgatggcatggccttttatttcttcaaagagcttacacatctacttatgtcattttactcaagaggcagtaggatttctttttaatcattacagactcctgtaggctagtatctattgcaaataggtatttaactattaatgggtgatttgtgcttctggtttttttgttaaagagaaaggaatggagctgacttgtatcaaaatgctgctcaactataggaagtggatacagtagagacataatctttggtaatttataactaacaaaaagtgagatcaacagcccagccagaagcttttgaaccacattaattacaaacctttgactgacctgtagctccttttcttgttttctcctccccacatggaacctggagcgtggtggatgcctggaatttttccatttcagtttcactttgaatagtatgaaacagtaggtagctgattaacttcaagagctttaggttagaacacactaggcttgagcgcccagagtgccatgccaagaagggaaggtgtctggcaagttggctcctatcgagacatccttgatgatctgcagcctccactgtgagctcacattaaagtacagagctgacactaaatcagtccacaagccagagtctgggtcggaaagcttctcggctaccactgactctaccattcaattgaaattcatatttcacactatactctcatatattaaatactctatggccctccactaaaggaatccctgttctcatccccaggatgtagcatcacagtgctcagagggttcaggtgcattggtggagaagttcagcaccagaaggggcctctttgtatcctggagttatcacaagattctaggtattctgaggaaatgatttctccatcactgcaacttgaactgggcttctaagactgcctctattttgtactccagaatcacccattccctacatatcttacccactgttcatctcaggagtacatcatccataattgttatgagatgatgacgcatctgcacatagtcacttaacacaggtacacccactcactctggtaaggttctgagtttgagaaatggtcaggggtgaaaggtttggccactgcttccttcctgatttggctcctcatcccactataggaggcataggcaacttggaaatcataaaccaacaagctcagtccagggagtggagacctgtcagctcttccatattcctctacccatcactataaaccttacccaccattccaaggcctttccaaataacagttattaaacttccctcttttatttccttgcttgtaagtatgaattttgaacctgggttagggtagggagtaaatgcacaaatagtatacaagtagtcgaggcactaattgctgactgagaaaacaaatgaagattgcggttatctgccatctatgaacacttatcttcacagtatgtccatggctgcaggtgtgacagtgctactgttgtttcttgcttgccagtcccactgcatgtaccttctcacctcttttccacatcagatgttgtcatctggtgtaagcacagtctgtgagtaattcttctgactcatcgccagagagggaggttcccacaggggtcagtgaggcagaaaagcacagaatttggagtcaagccagatttaatgcaaatcgcagctcaactattcttttgctgtgtgatcttggtaaagttaatgagtgaactcagcttccttatccttataatggagataactcatagaatggtggtggtgtaagctttttgttgatgatagtggtggtggtgattttgttctgttttctttttgtaacagcatatatcagtccccatgatatacaggagtgctcactgcaatgaagttccatttatgtgaacttagattatgtgaatttaaagcaaagcaatataaaaatactaacaaagtcttagtccatgcacaaaacatcaaatacaagatattttactttacattattcctgtggggaaaactgccttgaattatgcaagttttgaattatgcagtgtcttcaggggctcatcccttacaagccaatgtgtctgagaatctacaatctgccaaatgagtgttaagttttatataaagtatcttattcaatccttcaatgaccccatgaaactggaatgtgtgggcccctactttgatatgaagaaatcaagattcaaaaaggttaagtaatttttccaaattcattggtcattcacctaggattcaaatccaagttggtctagcttcaaaaatattcattatttttccttttttttctttcttccatatcttcatagtctcccagtttttctcttctctttctttctccttttctctctctctctcccatgcacacacacacaaacacacacactctctgactacacaaacatttattaagtgaagcatcatctcatcatctccccaaagcccattgttgtctttccaatactgagatcacccaattgggtcttttcttcattgagattgtttttccaccagtgggcaatttgttccgaatccccacttcccccttattcctgcccttgttagataataaacatacatcacttgttttgtcactgaaggtgcaggcacaggaagtagactatggcaggaatcaatgtgcttgtctatcagccaaaaatgtagtgacgtggcagacataagcacagggaagaagatgctgcattgccctacttcctccagatgctaacccctccttcaccttgactctctcagatgcctacatttgcaggaggctgagacttagaggtgcctttctgcagagtgtccctatggtgcctctaacaatggatatcacctggtgttgcttgtgtattctagggctggcagttttactcttcttgtacctctccactcatgaaactcacacggatagtaagttttggcaagctactttaaacaattttctgaccaccataatggagagaaatgtattcatctttggaaagaatatcaactcactaggcctgtgtaccgtccaatgcccaacaaactaattggtccccaaaggtccatttataattgggtggttcctgcagataccaggcttggaggcattgccactcagtgtctgtttctgcaaacagcactttaataagtaactctttactcaactactcagtatagaactcaacaatattagatatggagagaaaatggggtgagggtggtgacactgggatgggccaggtagtcagtgctgtcatcatccatctctgccaaggaaatctgatttccccagcattaaatggcaggtgtgagctccttaattaggcaataaaaatggcaacttggcagtgaaactataaacatgaaattgtacagcaccatgaatctttggcaccaggattaacttgactatatttttttctcgtgatacagttactgaatataggtaagagatcaaacagaaaaagcaaagccagaattctcattcccacctctgttaattactagctatataaagtttagatatgcatttaataaactaatttccccccaaaatgggaatggaaagcatgatggtatactttatagcactcaataaaagataagttgattggagttaccaaagccttctattttatgtaacagaaacacatctcaggctactgtggccaacagttatctctcatttcaacagctgcattaatcaaggttaattacatattttccacatataaattagataaaatgaaattgtactgtacagaaaactattctgctttaccaatagttttcaggcatagtttgagaataattaaacatttttatttgtataaatgtaagtggcacaagtgcaattttgttacatggatatattgtggagaataattaaacattgactcaagcaggtggatatgaggaatcattccacttaaagaaggaatatctgaatattttgagattgccctatgaatttcattttgtttcttttctattacaaaacaacacttgatcatagtcatttgtgattttttctccactgtagtgaactgctctctgtacacattcattagcaatcctccttgattagctgctggaggaatgtcgcagttctctggggtcagcctaggggctgggaatgtgaatatactttagttggcacattatcacatggaagtgccttgcccatgaggaatggagagggtatccaagctgtaaggacattcaagtaatccttgtacaatggtgactcattcttctgtcctggggataaacatcatgtagaaaatgtcccaaccaataacatcaactggcttcatggcacaggaaacagtacagtgtctgaacacagacaaaacaaattgtggggctaaagtaaataaattcatgacttgattttctactttgaaactgaactaatgatgtaattcatgaaaaaaattgactcaataaaacttgccaaagttttcaaaaatgccaagacagtattaaaaagaatattaatgggaaacacctctaagaaatgtctatacaatgcgaaacaactgagcaactaaccaaattccaccatctcacttatctgttcaaacaacagataaatgcttatctagcaccatgaaactctaaaccacttgactggttctactttcccgccagatatatttgcaaactacataagttataaagtcatctaaataataagtattctcctttccgttaatgaaaataaatccagagtaatttggatatcaacaactatcatctctaaaagaccaaaactacatttttcttctttttagttgtcttttttttttgtagcttaccctttatataaagcaataattgtgaaaggaatttgaatttatatagcacttggaaaatttgacagtcaacaaaaacttacagggacacttactatatgcacaaaaacttgtccttggtggcatggatacagaagacattactggatctatattcccccaagtatcctatactttagttgggtggataaaacacatatgcatgaagcgaagactaaactggatgattctatctttaagtgcgttacaaattctaaagatgggcaagacgaccgtgggctagaataggcaaagaaattatcaccttggggatggaatttggtctactccttgaagaattatctggaaataaacagatataaaatgtgggaaatgtttctatgctgggagaagagtgtagaccagggtttttccaccttataacactattaacatttgggactgggtaattatttgtcataaagagctgtcctttgcattgttgggtatttaacagcatccctggcctcaacccactagaaaccagagcaactctttacttcccagatggaacaaccaaaaacatcttctggcactgctgaatgttcttcagagcaacatcacttctggttgagaaccactggactggatatagttacctcggttttttgtttgtttgtttttgtttttgctttctctctctcagggttttccaacctcagaattattagcatttcgactggataagtctttgttttggatgctgtcctgtgcataataggatgtttagaagcatccgtgacctcaactaccagatgccaatagcactgctccctggttgtgacaatcaaaaatatctccagacgttgccaaatgtcccctggagtgaaaagtcaacctcatttaggaactactggtgtagacaaagtcatcagtgggaatggatttggcttactcagggctaagcaaaattgtttaaacaaaacaccaagcttgtgttatgaaagagtgcaataagattgattaactagggtagacacatgctgtgcgaggccttgaataccagagactgcaataggcagccacagtaattcctaagcagatgtgtttcaaaatgaaattggtgttttaaatttaatttcacagaagcaaaagactaggtgccatggggaagaactgaatgcagggggactggttaggaagttgttataataaccaggcattaggtgttgatggataggattaaagtgacatctttggaatggagagagtaaagagtaaacccaggattgctttacagagagaaatgttgagtctgtgcaatagattgagtattagagatgaagacaatggagggggaaacagtggtaaaaccaggttgctagtgagaagaaagatttaaatgagatgaataagaaggaggtggcatttaatatgtttaattttgcaaatactaactagctattttagtattatcacagaatgctgctgtgaggtcagggctgagggaataatttgagagctttggaaacacaaaaccttcatatcctcaatgaatttatccactcctatagctttcttcttattcctgtagcttgacaaaataaaaatttccttctcactcacattaaactctactatggggttggtggccctaggtcttttggggatccagccttcttccatcttacggcactgccatcttaaaccggtgacatctaaggtggctgcagaaggtatagtcttaagggcctcatggaagattttagcggtcctaacatgtgtaacttctgcctacattccatggaggatccaaaagaagtggcaaatccagcttactggtagaggaaatgaaatttagaagaatatagccagtctctgttatagcgctcaacatacacaccaccaccaccaccaccaccaccaccctgacacacagaaataagaagaaagctataggagtggattaattcattgaggatatgaagatagagtgaaaactgaggaggagagttcaagaaatggaaataccaaatggaataagatgtcccaaagagagtaaggaagatcagatgattcagagatgttggagagcctagaagagaaccaacctatatagaggtgaaagtgccaagaagacggaaggtaaatttccataaggaggataatgtctactttgctaagactcttgctttcatcagaggcaaagagcatcatgatgattgttaaaaaaaaaaagaaaagaaaaagacaccttatacatctatactccacctcaaaaccatcattagcttatctttacaaatttttgaaaccccaaacctatcagcttggctttcaatgccttcttttgccagcccagcctaactgtccacccctcaccgttaactcccaggtgcccagcatatcccggtcactgggttgctcattattcgcaagaccaccatactctctcccatctttacagctttgattttacagcttcttctacccaccaaagacctggctctcctcaagcctaaaacaagtgctacaccacctaggaataaagcctttactgatttttccatcgatattaacctccccgtattctaccgactttttgtccttcctttactttgtcatgtggaaccatctactttatatcacttatatgttcatgtgactgtttccctcagtagaccatgggattcttaagtggtgaagcagggccactaagatgtacaaccccaagaaaaacaagataacactaaagtctaggtcagaggctggaaaatgttttctgtaaagagccatatggtattttaggctttgtggccatttggtttctgtcacaactactcaactgtaccattttagttcaaaagtatccacagacaatatgtaaatgaatgaatatggctgtcttcaaataaaactttatttataaaacaggcagtggactgaatttgatccatggactataatatgctgctccatgatctatgtgaatgatactttctagagcacagcatgagtggggtcccctgaaatataatctgggaagtcctggggagaattaatatacttcttagtcatctttgtatcttttaccccatttcccaccagcacctagtagagccttcaatgtagtatgctctcaatgtttgtttttgtttttctgaattaaatatgctatgcctgaaaagataccaacttagttaatcataacagcactttgagaacttcattaccttttaaaactatcttgcaagtttgtagtaaagtagttcaagaaggaatcttgtaagcccaagaatcataaaaataatgtaacaggggaagatgtgagctcaaaacatctaaggattagcagctgaaagaagagaatctgacatcagagctgggtaaaagcaacaaaaaggcatttcagttctgagaaaccagcaccaaggaacatcacatcatatgtgatagatgtctcacaacaccctctaaatccatgtgaataatgcatttaatgccagcacttcaatgctggaaagatgttcatgatttggaggaaactcagagagcaaccaaaatgattaagagactgaaaggactcatttgtgagcagctgaaaaagaagccaaatatgagcttggtctgctgattgctagaagatggggaaaaggtgtataaattactgaatgctgtaaacaccaggaagaggaggaatgatggtcagctctactggacttagctcttggtaggcacatatctcgggcattaacacattcctctcattattgggtcttaaaacatttatgggccatgtgaataatatataactggaaatgctgtgattggtaatgttctattattacaggaaaatagtataacttaattatactttaagttctaggttaaaggtgcacaacgtgcgggtttgttacatatgtatacatgtgccatgttggtgttccagaagagcaaatacaagacaaactattaaggaagcaaatgttccaggaatgttaggcgagctaagagaataaaaactcactaatagtacactcttagaagtatcaaatatatacaatcgtgggtaacagtatatcattcataactgtttaaattaaagcacaaagatgcaaaaatagctagatatttccttcctttccttccttgctttcttccttccttccttctttcattcaattcattcattcattcaaccatcagtccatccatcatagatccatccaccatgtatttatccaccaatccatctatccatcccacataactactgcctatgcactatttgctaggtcctgtgctggtgatacaaagtaatactgcacagggcctaaactaaaaacgaaaacaaaaaaataaacctacagtctaagagtagggtcagggaatactttaaaatataactggccgggcacagtggctcacgcctgtaattccagcactttaggaggctgagatgggcaaatcatttgaggtcagcagtttgagaccagcctgggcaacatggtgaaaccctgtctctactaaaaaatacaaaagttagccaggtgtggtggcacgtgcctgtaatcccagttactcggcaggctgaggcaggagaatcatttgatcctgggaggcagaggctgcagtgagccgagatcgcgccactgcactccagcctgggcaacagtgcgagacaccatctcaaaaaaaaaaaaaaaaaaaatatatatatatatatatatgtatatatatgtgtgtgtgtctatatatgtatatttatgtgtgtatatatgtatttatatatgtatgtgtgtgtgtgtgtgtatatatataaatatatataaaattgtaagttgagtgagatgagggacatcttccatgtaaaaagtgggctaagaaggaacagataagttcaatagagagtgataagggaacaaagaaacatggcccctaactcagatgagagaaaggggaaaggtcgggatattcccaggggaattgatatcttggctaagtcctaaagaattctgaggcatctattaatcagaaggagtgggaataaccatcccaggtaggaagaataatatgtttaaaagactggagataaagtgctagatcattttatcacaacacatgtggaactgatacaagtacttcagattgttttagacaaatagtgtaaggcaggtggtgatcttaaaaataataattagaatatattatgattgtgggtgagttttatgttccttattaatttttgtctcttccaaaatttatccattaacaaaatcacacccttctatggccaaataattgcaaacatttataaggacttattctgtgtttgaaactattttaaaatctttttttttttaattatactttaagttctagggtacatgtgcacaacgtgcaggtttgttacatatgtatacatgtgccatgttggtgtgctgcacccgataactcatcatttacattacgtatatctcctaatgctttcctttccccctccccccaccccacgacaggccccggtgtgtgatgttccccttcctgtgtccaagtgttctcattgttcaattctcacctatgagtgagaatatgcggtgtttggttttttgtccttgcaacagtttgctgagaatgatggtttccagcttcatgcatgtccctacaaaggacatgaactcatccttttttatggctgcatagtattccatggtgtatatatgccacattttcttaatccagtctatcattgatggacatttgagttggttccaagtctttgctattgtgaatagtgccgcaataaacatacgtgtgcatgtgtctttatagaagcatgatttataatcctttgggtatatacccagtaatggggtggctgggtcaaatggtatttctagttctaaatccttgaggaatcgccacactgtcttccacaatggttgaactaatttacagtctcaccagcagtgtaaaagtgttcctatttctccacatcctctccagcacctgttgtttcctgactttttaatgatggccattctaactggtgtgagatggtatctcattgtgcttttgatttgcatttttctgatggccagtgatgatgagcagtttttcatgtgtctgttggctgcataaatgtcttcttttgagaagtgtctgttcatgtcctttgcccatttgttgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctaatggtattgcctaggtttccttctagggtctttatggttttaggtctaacatttaagtctttaatccatcttgaattgatttttgtataaggtgtaaggaagggatccagtttcagctttctacatatggctagccaattttcccagcaccatttattaaatagggaatcctatttaatgcagtgcaccagcatggcacatgtatacatatgtaactaacctgcacattgtgcacatgtaccctaaaacttaaagtataataataaaaaaaaaagcagaatcagtagggccatggagaattcttagctaagaattttattatgggcctataatgtctatgacattaatttgatgggattttgctacgtgaatgtacagaatagtaaaacttgggtttcaaaaataaaaaactaaaaaataaataaataaatggggaatcctttccccttttcttgtttttgccaggtttgtcaaagatcagatggttgtagatgtgtggtattatttctgagggctccgttctgttccattggtctagatctctgttttggtaccagtaccatgctgttttggttactgtagccttgtagtatagtttgaagtcaggtagggtgatgcctccagctttgttcttttggcttaggattgacttggcgatgcaggctcttttttggttccataggaactttaaagtagttttttccaattctgtgaagaaaggcattggtagcttgattggggatggcattgaatctataaattaccttgggcagtatggccattttcaggatattgattcttcctatccatgagcatggaatgttcttccatttgtttgtgtcctcttttatttcattgagcagtggtttgtagttctccttgaacaggtccttcatatctcttgtgaactggattcctaggtattttattctctttgaagcaattgtgaatgggagttcactcatgatttggctctgtttgtctgttactggtgtataagaatgcttgtgatttttgcacattgattttgtatcctgagactttgctgaagttgcttatcagcttaaggagatttttggctgagaccatggggttttctaaagataaaatcatctcatctacaaacagggacaatttgacttcctcttttcctaattgaaagccctttatttccttctcctgcctgattgccctggccagaacttccaacactatgttgaataggagtggtgagagagggcatccctgtcttgtgccagttttcaaagggaatgcttccagtttttgcccattcagtatgatattagctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttccatttatacgctggattacatttattgatttgcatatgttgaaccagccttgcatcccagggatgaagcccacttgatcatggtgggtaagctttttgatgtgctgctggattcggtttgccagtattttattgaggagttttgcatcgatgttcatcagggatattggtctaaaattctctttttttgttgtgtctctgccaggctttggtatcaggacgatgctggcctcataaaatgacttagggaggattccctctttttctattgatggcaatagtttcagaaagaatggtaccatctcctctttgtacctctggtagaattcggctgtgaatccatctggtcctggactttttttggttggtaggctattaattattgcctcaatttcagagcctgttatgggtctattcagggattcaacttcttcctggttttgtcttgggagggtgtatgtgtccaggaatttaaccatttcttctagattttctagtttacttgcgtagaggtgtttatagtattctctgatggtagtttgtatttctgtgggatcggtggtgatatcccctttgtcattttttattgcgtctatttgattcttctctcttttcttcttagtcttcctagtggtctatcaattttgttgatcatttcaaaaaaccagctcctggattcattgattttttgaagggttttttgtgtctctatctccttcagttctgctctgatctcagttatttcttgccttctgctagcttctgaatgtgtttgctcttgcttctctagttcttttaattgtgatgttaggttgtcaattttagatctttcctgctttctcttgtggcatttagtgctataaatttccctctacacactgctttaaatgtgtcccagagattctggtatgttgtgtctttgttctcattggtttcaaagaacatctttatttctgccttcatttcgttatgtacccagtagtcattcaggaacaggttgttcagtttccatgtagttgtgtagttttgagtgagtttcttaatcctgagttctagtttgattgcactgtggtctgagagacagtttgtaatgatttctgttcttttacatttgctgaggagtgctttacttccaactatgtggaagtaattttggaataagtgtgatgtggtgctgagaagaatgtatattcttttgatttggggtggagagttctgtagatgtctattaggtctgcttggtgcagagctgagttcaattcctggatatccttgttaactttctgtctcgttgacctttctaatgttgatagtggggtgttaaagtctcccattattattgtgtgggagtctaagtctctttgtagatctctaaggacttgctttatgaatctgggtgctcctgtgttgggtgcatatatctttaggacacttagctcttcttgttgaattgatccctttaccattatgtaatggccttctttttctcttttgatctttgttggtttaaagtctgttttatgagagactaggattgcaagtcctgccttttttttgttttccatttgcttcgtagatcttcctccatccctttattttgagcctatgtgtgtctctgcatgtgagatgggtctcctgaatacagcacactgatgggtcttgactcttaatccaatttgccagtctttgtcttttaattggagcatttagcccatttacatttaaggttaatattgtcatgtgtgaatttgatcctgtcattatgatgttagctggttattttgctcgttagttgatgcagcttcttcctagcctcgatggtctttgtttttgcagtggctggtactagttgttcctttccatgtttagtgcttccttcaggagctcttttagggcaggccttgtggtgacaaaatctctcaacatttgcttgtctgtaaaggattttatttctcctttacttatgaagcttagtttggctggatatgaaattctgggttgaaaattctttcctttaagaatagtgaatatttttccccactctcttctggcttgtagagtttctgccaagagatctgctgttagtctgatgggcttccctttgtgggtaacccgacctttctctttggttgcccttaacattttttccttcattccagctttggtgaatctgacagttacctgtcttggcgttgctcttctcgaggagtatctttgtggcattctctgtatttcctgaatttgaatgttggcctgccttgctaggttggggatgttttcctggataatatcctgaagagtgttttccaacttggttccattatcctcgtcactttcaggtacaccaatcagatgcagatttggtcttttcacatagtctcatatttcttggaggctttgttcatttctttttactcttttttctctaagcttctcttctcgcttcatttcattaatttgatcttgaatcactgataccctttcttccagttgatcgaatcggctactgaagcttgtgcatgcgtcacgtagttcttgcgccatggttttcagctctatcaggtcatttaaggacttctctacactgtttattctacttagccatttatttaatcttttttgaaggtttttagcttctttgtgatgggttcgaacttcttcctttaacttggagaagtttgatcatctgaagcctcctctcaactcgtcaaagtcattctccttccagctttgttccactgctggcgaggagctgcattcctttggagggggagaggtgctctgatttttaggattttcagcttttctgctctgttttttcaccatctttgtggttttatctacctttggtctttgatgatggtgacgtacagatggggttttggtgtggatgtcctttctgtttgttagttttccttctaacagtgaggaccctcagctgcaggtctgttggagtttgctggaggtccactccagatcctgtttgcctgggtatcagcagcggaggctgcagaacagtgaatgttgctgaacagccaatgttgctgcctgatctttcctctggaagcttcatttcagaggggtacccggccatgtgaggtgtcaatctacccctactcaggggtgcctcccagttaggctactcgggggtcagggacccacttgaggaggcagtctgtctgttctcagatctcaaactccattctgggagaaccactactctcttcaaagctgtcagacagggacatttaagtctgcagaggtttctgctgccttttgtttggctatgccctgccccgagaggtggagtctacagagtcaggcaggcctccttgagctgctgtgggctccacccagttcaagcttccaggccgctttgtttacctactcaagcctcagcaatgacaggcgcccattccccatcctcgctgctgccttgcagttcgatctcagattgctgtgctagcaatgagtgaggctccgtgggtgtgggaccctccgagccaggcgcaggatataatctcctggtgtgccgcttgctaagaccattgcaaaagtgcagtattagggtgggagtgacccgattttccaggtgccatctgtcaccccttcccttggctaggaaagggaattccctgaccccttgcgcttcccgggtgaggcaatgcctcaccctggtccggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtactattattgctcctattttagggatgaggaatagaggcagagagaggttaaataacataactgaattatacagatagtagcagagcagcatttcctaattggggcatcttactccagaatctctgcttttatgtccactgtgctcctgcaaaccttctaattcaagagcctgttttcatatctttacttctgtaactcacctaaaagttgatccaacaaataatcagggacacagtcaagtattttgggagaagaatgttcatagcagcaaaacttacagtcataaaatattagatagaaaataacctatatgtcctacaatgtagaatgtttaatcatggtatagaccattaggcaagcattagaaattatgatctagaagaaaaataagtaacatgggaaatgctcagtataaaggtcaaagggaaatgcaaagatacaaactgtgatcctagcaatgtgtttgtgtgtgtgttcagaaaggaaatccattagtcagactgagttccaattccaatcttgactctgtcatttattacttttgttaccttggataataatttcatccctctttaccccagttttctcatcagaaaattgggatgagttgttgtaagggttaaaaaattcacacatgtaaaatgcttaaaatactggctggcaagcacttgacagctatcaaaatataggaaactctatttaaaaattagaactgaatagtacacattcagatggtagtttaataagtattctttgtagtctaggatccaatattttatagcttcctccaattatttttcccttttacacttgaaaaaataattgtaagtcgagtgagatgaggggcattttccattgcaagcaaaaagtatttgctttcagaatctactttgtcaaattataagacttactaaacacttaagcaaacactgaagggttatcaaagttttctttttaaccagataccttctcaaggctgtattcctcatattttactttggttgaatactctttaattgtgaggatttaaaactatttagaactgtgttttcatgtcagttaggatcagtaaattgaagaaaattacaaattggcttttgaagagcctaaggccatatatagtttatttctcatccatgttttgaaattatcttaattatattgatttttaaatttcaatttaaaaaatagaagtgagcagtttgaataatagcacccatctattttgcctcaaagttttgtttttcttgtctaattaagagaataattatttttaattgataagtaaaaattgtatatatttatggtgtataacatgtttcaatatatgtacacatcatggaatgtctaaattgagctacttaacatatgcattatttcacatatttatttgtagtgagaacacttaaaatctgtcattaaggaaattcttgaagtcattggagctggtctcaggaataaagctactggttcaggggcgtgtgactttcagtgctctgcccagaatcttcaaagtagaatcaatggcttaagcactttcttaagaaaacgctggaaaatcattgaccaaggaaattaggttattttgctgctcacaccattaagaatctggtttcctggcaggctttcatagtctttctttctctctctctctctctctgtgtgtgtgtgtgtctctctctctctctcaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggtatgattgcccctcagttcagacaatgtagagcttgagttggttagctaggcaatgtaattcagaaaacagaagagcacacaataagcaagaagccaaggttaatttttgttctgatttgtcctactacactgacttagtgctcagcttaggcctttaaaattggggaggattgtcagattcagcaaataaaaatacatatcatggagttaaactggaatttcagataacaagaaacaatttttagtataagcacataccaaatattgcatgggacatacttatactaaaaattgtttatctgaaattcggaagtaactgggctccctgtatttatctggcaactctaattggggatatatacttgatttgacaaagttactttaaaatcctggttcttctaaatattgactgtgtgtgtgtgtgtgtgtgtgtgtgtgtgtgtgtgtgtgtgtgtgtgtgtgtgcgcgcgtgcgtgcgtgtacatcactgatctgattgactttttttcatcaattgctctggctttatgtaaattatgccgtacccatgtagattgcaacatgataaatccagtgagactggcctcattatctcaacttaaactttagtgcagaattctaagctttacactgtccagagacttcaggtttgaaatgcatagctcaagatctccagtcctgtggttcccaaacttgcctgcacattagaatcgcctggggatattttaaaaatcccaagccttagacacaccttacaccaactaaacctcaatgttaggaggggcaccagcctctgtatttctgcagctccccaggcaattctggtgtgcagacatgcttggaaagcactgttctggtttataacccaatctcatagaggctatcaaaaggcttgcacctgttttccatttcaaactctgggagagaaacataccctttgatatgaagaatgttacctcctgtaacaatattgcttgagaactaaagttaacattttatgtacagtagagagagaaagatttttcaaaatctgttccagaaaatatttgataaattaatcctgctggtgaagtaatagttatatgctactctgttggaatgaaaacaaaaatatttcacagtccctattaatgctgcaaatacctagatgtaaagctgaatatttgttgtgagacattgcttatattgaggagtttatgtgggtatgagctcactgagttctgactgcatccactgaaaggtttcctgcacatactctgggctggaagagataaatctatcctgttagctgccctgtctcactcttcgctacctctcaggaacattttgtcctgccatagataaggaaaacaagtaaacaagcacaaatatcctctttgctgtacattaccttttaatgttgtgcctttctcaattttctcctcactgcctccctgttggtgctaacgtttctttaatcacattcacagaagtccagcacacagcagcaaaagttcaggatcacttgtgccacctagaaaatattcttacattacgatggtatttcaacacaaaacagtacagagttaaaagaattcatgctgcaactgtctattggtcagtggatggtttaagtccttcaacaacttcttttacatatggtaatactgctcaggtttcccaaacttaccttatcataatgagactcacctaggacccttgtgaaacatactaattctcagcaaaattcctttcagatgttgatttataaagttgggtggaatacaagaatctgtacccttaataagcactctaggtgattattatgatgagataaatttaagaaacactatcctggcttactgactgcatactctcctagaccaaagatggaaaatgggtttcattttgcttcccaattctaaatagttgttagggaatttttgaaatgctgtgtgaaggattcttagactgtacctgggctctgtgggaatgagatctgtcatcaattagcaatgtctggcattacataataacagatattaaagactaatttttaaaaaagtataactagcaaacaaggggggttggatatggaataataaacagacaaaatcaatctaaagcaccagcatggcacatgtatacatatgtaactaacctgcacattgtgcacatgtaccctaaaacttaaagtataataacaaaaaaaaaaaagaaagagggaatgcagaaccagacagacaaagagaaagcaaatagagaagtggtagattaaacccaaatatattataaatgcagtaaagaaaaatagaataaatacctctattaaaagacaaacattttcagatgaaatttaaaaataaaactcaactttagtcagcctccaataggcacacctataatataaagatagagaaagcttcaaagtaactgtggataaagatatctcatgcaaacactaaccaaataaagccagtttagctccattaatattagataaagtagactttaagaccaaaattattactagaaatagagatatttcataatcaaaatgatcacttcaatagggggatgtgattactatagatatgtctacaacgaataacatggcctcagaatacaccaagtttaaattgacagatataaagaagaaatagacaaactcacactcatagtgaggaattgtaatatacctctcagcaactgatagaaaaaaagcagacagaaagatcagtaaggatataaaacatttaacaacataattaacaaactacaccctcaaatgcagtaaacatatacttttcaagtcagaagaaacattttggtatatttatcatgagttggactataacgcacctcataacaaatatcaaaacactgaaataatattatctgagtaaatagaattaggctaaaaatcaatggtacaaagataactagaacatctctataaattgggaaataaccaaatacttctgaaataattcaggaatcaaaaagaattcacattggaagttagaaaatattttgaattgaaagataaattgtacatatcaaaatatatgaactgagctaaagccatgcttagtgaaaaatgtatacttcaaatgcatattttataaagatggaaagctgaaaactgattatctaagaatctatttcatggagacaaaatgaagaataagatattaaatccaaagagtgtagaaggagtgaaaaactatgaaaaaaaacacaaagagcaaaaattaataaaataaaagaatggtccattaagtttactgattatcttgtcatgaatgttttcaaatcagcatttgggaagaaccagattgcagtagtttaaggtaggtgaggatatggaaaaagcaagtatagattacttgaaaatttagctctcaaagggagagagggtaaaacaaatttctgcacaatctcactccctgtcatcattagactactcacaggttaaatatatatattcattcaaaagatgtttattgagcacctactatgcttaaacatggaaagctgtgaatatagtagagaatgagagggacaaagaagtagaaaatgaggttgaaaaataggtaatttcaagatttatttgcaagccagtataaaggattttattttattctaagtgattggaatccactagttagtttcaatatagcaaataggctattgagtggatagttgtggtgtcaagagtagcagcagataagttaggaggctattgtagaactataggtggaaatgttgatggcttagattatggtattggtcatgagaatgaaggaaagtggttaggttcaggattctttcatttgttccacaaaaatttatttacttcttactatgtgccaggcactgtgtaaatccttagaatacgttgcttcacaggacagaaaaaaatgcagccttttgatgaaacttacattctagtggttatgctttggaggtaaaaccaataggtcatgctgatgcattttatgtgaagagatgagaagatgaattgaatatgactcacagatttttggcttaagcaactgggtaagtagtgttaccatttattaagatggggactattgtgacaagcgcagatttggagtggaacttgagtcacatttttatgctcttaagttcagatgcccatgagacatctcgatagagttggcaagtaattagatagaaatatatgttcaagaaagggataaaatctggaaatgtatatttggcagtgaccagcaaacagatactgttttaaatccacaaaactaagtgagattacacattgagataacagaaacaaaaaaaaaagctctgagaatggagcattccatcatttagaaagcctatctagagtggattgggcagaaaaaggaacaaaggaaatggtgacaaaccttagatatcacttgcaattgcctttactgtgcaggggaacatagaagatggtatggaataaaatgtgtgctcatggggggatatattttttccaaaatggaagataaaagaatgcatttggcaaaggaaaagggaggtattcacattgcagtgaaaggagggcataatttcaagaacaaatgtcttaagaaggtgagaaaaaataaaattcaaagcaaagggtcagggttggcattacatggagacaactatttcacccattttaataatgacttaaattattgccagttcatagatggagatactgaagcacaaagaggttaaatagcttgctcattctcatgagccaagaagtggtgtagtgggtctgaagtgagatactgtgttcccagagtctgtgtgcttcaccattgtacaaacaaaatgggagaatgactatggttgctagccaattggtatgtccaattatgataggatgtaggagctcctaactaatagctcctatcatgtccatgaattctgaggctatcagctaagagtatggtggaaaaaagaaacataggtttgaggaagaaggatcaagtattaaatagtagtttgggagggtaaaaaagccattcctccaagaagagtaatggggcagaatgctgaggcagaggcagtgggagtgcccatatgagaactgtggttatgactttaaagtgtgaacaatcaggaggtatgtgtttccccccagcaagcttccaggatcagattcaggtactgagataacaggtacttcggtttaactacaattgaagttttgccaaatgagcaggaaagtgagtggaagacaaagagaagacaatagaggagttgaaagaagagaatgtagaagggaagaaggaaggaagaaagaaaccaagaaaggagaagaagggagggagagtgggagggagggagaatgggatggagggagagtgcgagggagggagggagggagggacggaagtgaagttaagggaggttgcatggcagtagttgcagtgatgaaccagaaattctaaggtggatagagaggggaaaacacggaagagacactgtattcaagagagagaaagagagagactcaaaattaagatttcacaggaagtaaagacaaagataaggttatgatcataaataagcatgtgtgactaaggttgggttgagaaaaaattattgacagcaaggcagtccaggaattggaaggccgaggatggggtctattatccatatgaatattgaagatcccccaataaagatgacattagtatgagtgttgggttgacagggaaatggatgctaaagtcatcaactaataaaggagtacaactaataaagggtaacagcacagataggtaacagcagtgataaggaaaatcagtagtgaagtctaatgacctgagcttcagagacgccaaaggatctgggtttgaggaaggaggaaaaagatatggtttgggcattgcagtggggagcaaaaaggataccttagattaaaagatgttttagagatgccagttggcagttacaatccctgctatgtttattgagaaatgcaagtttgcatgtttgacatggagatgttcttaagtttgtgtatggctattcagaacataatgttttattaccaaagttaagtcttggggggagttgaagagcaaatcaaatcatgcttaagctttgtggtcaagtttcctaattatcaccgatggttgaattttgaaaaaataggcaagaaatatttccaattatttgtcccttaggaaaggcagcatttttcagctttttaaaaaagtctgaaccatggttagaaaaaaaaaaatgataacaagagctaacatttattgagggcttactatatgccaggtactcttctagatactttacatatagtaattcatttaatcaccactacaactgtgtgagtaatgcaatcatacagcccagtttacctgggaaagtcttgatttaggcctatttttccaataccttgtgtgatttagaatttgtcctggattactcattttaaacaaaatgttttttattaatagttgcattaaaataagtggaaacgggtttggttgacctccactttatagacctggattctgtcatagggtgatcctccggtataggggtatgcatgtgcagtgaacgagttctcaccttaacacatggtgaaatcgaaaaaataataataatcactactatccaggcatcttttcttcatatgttccagatgcagtgtcataactaacactccctttccaggatagcttgcgggaggggagcttgcttataaaatgaagtgcaattggacaccagaggctggggacagatgttgctctctatcagtgatgggtcactgctgcccctactggtcacttgggataccagccttgttctatggcatggcatggcatggcatgcaaaatccatgaagccaccgggctatcacttcatagggtcagtgggaaacatggaaaatcacaggttctgtacacataaaaaggaaagaaaaactgagcagtcttgctgttgagcatctgaatgctcataattgagtgatttttttcatttttgtatgatataaatccgttttaactacgttttattgtttgataaaacttttttttactttgcaattgtcaacattatagagttgtaatgtctgtcagtgccacttgccactatcaaaattgtccttgtttggattaaattgagtaaattaactaataacaatgaagatactgttcttatctcaatttacagatgaggaaactaatgcaaaaagaaaatagggtgaggcaaggtgaagcaaatagggtgaggcaagtgagtcacacaagtacagggtcagatcctgttttattttttatttaatgttttgttcaccatggattttttgtattaataatgatattttcaaacattgcattaaatatcatttgagtactggagttttgggtaccccctcagattttgcccctgaggcctcacttgttttcccctagtttggggcccacctagtcatgaactactaaattaattttcacagaaatgcattgtggcctgagttaatttttttttaattatttaaaaatgttcaatattttggccgggagcggtggctcacacttgtaatcccagcactttgggaggccgaggtgggtggatcacctgagggcaagagtttgagaccagcctggccaacatgtgaaaccctgtctctactaaaaatacaaaaatcagccaggcatggtggcatgcacctgtggtcccaggaactcatgaggctgaggcaggagaatcacttgaacccgggaggtggagattgcagtgagctgagatcacgccactgtactccagcctgggcgacagagtgagactctatctatctcaaaaaaaaaaaaaaaaaaaaaaaaaaaagtaaatattcccaaggcaatatgtcatctctttaatttcctactgagaaactgacctctgaaataacatacaggttgatattttagaaggtataacaaaaaacaagagcagatcatctcccaaaaagacaatggcattaagctttattcagggaaggtatttattgagagaacacctgagattacatttacatgcatgggaagagtgtctggtatttactgagcaatcaagttatcaaatggggtcactttcaaggagtggccgggcaatgtgcaactaggtgtatttgctttgattatcttttctaggttttgtaaagcagccactgtcaattttatcaaaacagagtttctcagaaacaatcacgcccagatcttccctgacagaactggccaaccccagtctattagaagctgatgccccaggtctatgcaataaaactctgttttaatgttatcgcctctgctccaataagaaatatgtgcaccatgtgaagttataacaacttctctacaatgcagcctcacctgcatttatctcccactttcattttatatctggctgcaccatgccttacttctggcattgtacctaatttcaaatgtttccagttacccagatagccctgacttctttttgttcagctactaaatagaaattgtggctgcttgagaacatggttatggcatgtgggccacctaatgacaagttgccttttacttatttttcttctattttgtttttaattgacacataatagttgtatatatttatggggtacaatgtgaggttttaaggttttatacattgtattatgatcaaatcaggataattactgtatcaatcatatgaaacacttatttcttcaccaaatcatctcttctagatattttgaaatatacaatacattatcattaacgattttcacccaactgtgcaatagaagaccagaacttattcctcctatctaactgtaacatagtacccactgactaacttctcctcatctctccctccccctcattttctctaggcactgataaccactattatactgtctacccccatgagatcaaattttttagattccacatatgagtgagatcacgtcctttgcagggacatggatggagctgcagggcattatcctcagcaaactaatgtaagaacagaaaaccaaataccactcattctcacttctaagtgggagctaatgatgagaacgcagggacacatagaggggaacaacacacactggggtcttttggagggtggagggtggaaggacagagaggatcaggtaaaactaatgggtactaggcttaagacctggggtgatgaaataatctgtacaataatctgtacaacagacccccagttacagacatgaccctcagtgtgggataggtgaaatgtgagagatggaggtagcgatgtccatgaggcagtccagcactcaggagagaggactgggttggacagacatgctgagaagtcattaggatatagatggaggttaaagctatggaagtggataagattacccagcaggagtgtacagagtgagaagagaagtggaggagaaaggttgagaaagagcaggaaggggcagggacggagcaggaagagggaatggaaggggaaggcagtgtaagggaaggcagtgtaaggcaaggcagagggctgagggcaaactcctgtgagcaccagcatatcagagacaggcagggggaaaggagcccatgagagagacagagaaggtcagacggctatgtaatcactcagaggctagaaaaagaaacatattcaggaagaaaattcatagtatctaaagatgtggagttcacataaaataaaagctaagaagcagccatggattttaggaagtcagaggacattggtaacctcaacaacagcaggctcagtggagagacggaggcagacacaagattttaggcagtgtagtagtgaagtggacagtgaggaagtgaggacattgaatgcagccattttatccaagaaaaagaggcagaagtggctgaggaggcatataggccatggatttttttgttggttggttggttcttttgctttttatttagtgttttttttaatgagcaacttgagtacatttaaatgctgatgagagagttgtttatagagagaataatattacttacaggagttttgaggaaaggtgggagagcatacttaggtggagccactagccatacccagtagaaggtattccttctgataactgggagacaaaagaaggaataagaataaggacatggcaagtttgtgggtgggtgggtaggcggacaggattttgaaggaatccccacatgatggcatctgattgttttctgtgacacaggaaacacattcattttcagagaataaagagggaggtgacagagtaggaggtgtgagaacagtgggaaaactttgaaatgtttgtgaattgcgaaatacatcaccaggaacccacagaagttttctcaagcaggcttagggtccatcggacgtaggggaaattggatatgtaggggcatcaatgtgctggattcggtgaggttctccagaggagctcagcagcctagaataaccagatggtgggttccacaattgatccaggcaggactgactgaaataaaaatgggcaacccctggttcaaaaacaattaagaatttcaagatggcaacagcagagcattaaactaagcctagcacccctctgtgtatggaccctgtgtgtctgcacaggttgcatgcccgtgaagccaatcttggatccaagctgagggttttgccagacaggatggatgaatggataaaaatatgaatcacgtgatggtccaagcagggtagagaaagggggatactgtaaagaagagatgagaatgaaaggagaatattttacacataagtgaaataaatgtaagcaataaaatgtggcagttagcccacttatttattctttatttgcaataaaacagttaactctagcttttaatttcaatgattctttatatttctatagttaccaaatttagttgaagttctagttttgcacagaccttcttaagggagttttgctttacagattttttgaagggagttcaatgtttaaatgagaaagaaaacttgtatcaactagtgtcctttttgtgttgttttgtttactggggtagacaggctcagacaaatatttcagtgcagaatgttgtgtgctgtgggaaaggtttaagtgcatgatttaaagtgatgactgaggacaaagcatcttctccacttggtagtgccagggagttgagcctttgtctgggtcttgacacaggagtagaaatttgccaggtcaaaaggaaaattaagaggatatccaggctgaggaaacggttatgcagaggttcagatgttagaaacgacatgatgctttcactacatcataaaaagttgagtcaggaaagtgctaaagcatggggcctaaaaggaaggaagacttcagttgctcttgaactgggagccaccaaaaggctttataaatgatagaatgctacaatcagattggaactgtggaaacatcactctatatagaaaggatcagattggaataaggcacaagatcaggaaaatgctgcttcagcatttcaacttaaaaacacccttaattttataagtagtctacacttccctgaagcccctccctagaggcatagatcattattactattttggtttgcctttttgtaattttgctagaactagctttccaaatctgggatgtatattataaacttaccaaagcttgtcttaagtgtgaatataaaagtggctttctggtttgaattctttgcagtaacacaggtgtcttatcattgctgtaacaaatcactacaaacttaatggcttaaaacaggaaaaacttattatctacacttctgtaggtccaaaatgggcctcactaggttaaaatcaaggtattggcaggactgcattgcttctggagggttgtcacgggggttcaagggattgggggccatatcaaagaaaaagatatgaccacgcaggcagtaatacacaacaaagtttattgggtggcacttggacagggttgcgtgaaaaggtggctcctcacagcatgaaatgatccagaggcttagagacaggggccaccatacagagaggagaggacaaggggactcccagtggggaggtgaatcagagggggctcacttgtctaggtgatgttgctcagctgcacagtgggggagcctctgggtcagagagcttcaaagagcagcagtgccatgggaccttataagtgcaaggaccagcagatgctaggcatggtttcgtgggctatgcaaagcagtcagggtctagatggctaaaaatctgcttgtttaggctatttttaaaataatggaatgtgtaaaatttgagtttggtgccagcaagctttggagataacaggtctcaacctatagtggggaaataaacaaccaaggggacaatactcagaggccatctttggctcatttatataacagtgttctaggggagaatctgatttcttgacttttccaacttctagagctacttacattccttggctcatagtcccctttctccaaaggggaaagttgttcaaagccataacattgcatttctctgacccttcttccattgccatgtgtacctctgaccacagttgagaaaggttctccatttctaagagtcatgtgattaagttgtgagcacgtagatcatctagggccctctccccatccttagtttcttaatcacatctgcaaagcccctctgctttgtaggataacatattcacaggttccaaggattaggacacagacatctttggtaggcattatcctgcctgccacaaacagcaatggtttccactgcaactctgagagcatccgttgggcactgtagcatgctccatgcacactcaggacagtccagaagtaccaggaggtgaatgctacaggagtggccctcaaccaatgagaactgggagttggtggccaaataccaagcttcctcaacccttggtaagtcaagtctcagtctctcagaggtttgagccccatttggcaaccatggtcacctgctgattattcacacatcctttattgacttttctcctttccttgtcctacacttccccactccctcaccacactcctgttgttgcctcccaagtaaacctcttgcatgcaatccctcatctcagggttgctttggagagaacaaaaacaaactaaggtgcaatgcctcctaggccaaggacctcatgagaatcacaacccactgaaccccatcctcggcctccccactaaacaccagattctggaggactttttgtgcctaaagtgtggaaacagagggaatctaggagcagcaagtgtcaaacaatggtttattgtaccttacagttggcattgctaaaatatttctgtgctgctgagcttctaaaataggtttcataacacaattctattgctttatgtccctgaaatcaagcctgtgccttcagctctactagtgtttcataaaggctatgatggcagataccttgaaccttcttctttcactatctagctcttaattggtgtaagattctttttttccactttaaaatccagatcctgcacaatggtttaagattcttgatggcaacttgagctgtagttatttcagcataactggactctcataaaaagatcgagctaaatgacagaaaagtctggtgcttccttggcattacatcagagatgtgggtttgcctaatcatagtagtaatttgtctctatcactgttattcttgtttttaacaagctgatttggggacaatatgcttaaatggagttatttcccacctgattgatgaggcagcatcagacgcgagtataaccgtttataaaataaatgaccttggctctgtgcaggagtgggtaaaaggaaacgacccctgccttcttagttttcattctaagctgctagacaatcctagatttcatttcttcaacaaatagtttttgaatgcttgccttgtacagtgttttgttttagataaggggcagataaaaaaaactgcttgaaacctgttttcacaaaattttagaggtcaatatcagaaaaaaagtacaaaaatgttctaatatgaggtagagaattttaagaaccataagagagttatagttggagctgtggcaattcccaggaagggagagtatagtgtacttccagctcttaaggagggaggagattctcaagaaagaagcagcatttgtaaagttcattttatcttagaatgttaactgtaagttattctaaactcatcttgttattgtcagtaaatgaaacagagattaaataattaaataggtaatgaaaactacattctttaaggtggcatttaatgctcattagaaagtagccttatcctgccttgctgatacacatttacatcagatgaacctggagagcttcccactccaagaccttcaagaggaaagtgagagtcagtgacacggaagctttgtttgatctaaggcagtggttctcagccaggagctatttttccccaccccaggggacatttggcaatgtatggaggcgtttttagttctcacaacttggggttggggactgtgtgtgttgctgaactctaatgagtagagaccaaggatgctgctaaacatcctacagtgcacaggatggtgcccatagcaaagaatcatctgacccgaatatggatagtgtcaagtttgaaaaaccctaatctaagggacagaagcatgctgtgcacacagaggactgaggtttagcttcatgagtgcaagctgcttatgaataaagatgtcactcctgtcaggagtaattaattagagctagtataacccagttgacaaaatagtcagaaaaacctttcattaagaatttcctcttttgtaagtgaactcttttactctacataaagttctttttatttacatcatatagcaaatcagggatccaaaatatggttctttgtactggtaatgaacaggggcatgaattttgttgggtgtatgatttaattgcttttcaaaatgttgacatgttgacatgggtgtaaaaacatcaggaggttaagttattaaatgcctccacttcattccactctatctgctgctgctaggatttgttcaagagcaacagaagtcataccagaaatgagctctggtattttctagaaacaaggtaacccattacagcatggttctcaatcctggttacacactagagacacctgggagctttttaaaatctaaatgcccagaccccacctcagaccattaaatcagaatatttaggtgtagagcccagacatcttggttttataaggcttcccaggtggttgcaatgtgaagccaagtttgagaaccttgcttctttaaatgtcatctgttgaccagcagcatcagcatcacctacagcttgctagaaatgcagcctctcaggccctaccccagacgtgtggaatcaaaaataacaggattctcaggagattcactagcacattaaagcttgagaagtgctgctctagaatatatcgcagagagtccacttttaaattgtatgcatgttgcaatatgcacagtctaaaacaaggcatactattactattaagacatggtaaaaagctccaaagctttaaatagaattattttcacttggtaagaaatattaagtttattactgtggctgcttgtgttttgcactaaattttatttttaattgtgaaagatttcaatcatatagagtaatttaaccctatgttgcttgttgttttgtttctctcaagaagagtaatcactaagtagcctaggattatcattctggtattaggagccaaatgggaaccccatgaaagaccttttcctataactgagaaggttccttctcagctctgtgttcacatacacaaggaggaaatgatctgaaatggcatgtaacaggatccatgatagagtgaggagcttcacctttgttaacaagattgaacagtgcacacatgcattgtagtaaaacaataattctaaatagtcatacaacttcattctggaaagcacaaaatgcttcaaattatggtagtttggcagtgatatctccacagggagtttataaggtttgctgaatgtcgtacagccaattcctgactgccagacctgagacgccttaattcaacacagaatcattgaatgttctttcacacttcctgtcttttagggcagattgattaaaataaaacttacaaaaatacctgtcttaaagtcagccttcttcatcccagccaagtaccctatcctgtcaatatgtttcattacagcaccatttcctggaattactgccattgaattcccgtcctcttaataacatatactttttctctccaaaacatgcaaaaaagaatatgagagagaagcatgacatagtgacacatgcttagggccaggagtccagctggctgaatctaaatcctggctggtgctttatttgctgggtgattagagtcatggcctaaccactctgggtctcagtttcttcatctgtagaaagagtctaataaagtcctttctcatgggctgctgttaggagcaagcaagattatgcacgtgaagaacagtgccttgcatacagccaatacttatgaagtatttcctttctcttcctttcgcctgctttttgacatgagaatattgcatgatacagagtttggagcatgaatcccttcaccctggtagtgagcttagaacctgataggtagttttttaacccaccccccaccctccaccctctaaaaaaaccaaaaaacaacaacaaagaaaatatcatggtatatcctgctttgtaaaagtaaatactactttgtgaaacttttgttgccattagatatattaatgtgtgtggaagtgtgtgtatgtgtgtcctggttagtaatggaaaatatgttttcctactttgacagcaaaaaaggtgtgtgtgtgtgtgtgcacgcgcgcgtgttgcatgcactgttagatgacagtctttattttttttctagctttaaggtataattgacaattagaaatcatatatatttaaggtatacgacttgatgatttgatatatgtatacactgtgaaataatcaccatgattaaactaattaacatgtccatcatctcacattgttaccagtttcttttttttccttcctttctaccttctttccttccctccctccttctttctttcatgagaacactaaagatctacccccttagcaaatttcaagtatacaatacagtattgttaactatagtcacattgttgtacattagatctccagagcttattcatctcacagaactgaaactttgtatcccttgaccaacatcttcccctttcccctcactctatctcttggcaaccaccattctactctctgcttctgtgagtttgattattttagattccacatataagtgagaacctgcagtatttcacagcaaaaagttttgaaggccagtgctctcagggtggatcaggccaggtaaacaaattcacctgaccatctcaggcttaaaccttctcacataccctcaagaggcagtcacagacacagtaggaggggtcatttggttgccatgatgacagggacaggaggtatatgttgcactaactatattgcacctcactaaaacttgctaagccctcgcttttgtttgaccagcccacactcacacgccacctgagtattatgatgcccatgacccagtgggctcatcactccgtgacctgccttcagagttcaagctgtgtcatcctcagctggacacaacatctgcccaattatacagcacacagctgggagaaaagagagacatcaggccaggcgcggtggctcacgtctgtaatcccagcactttgggaggccgaggtgggcggatggcctggggtcaggagtttgagaccagcctgaccaacatggagaaaccccgtctctactaaaaatacaaaattagccgggcacggtggctcatgcctgtaatcccagctactcgggaagctgaggcaggagaatcacttgaacctgggaggcggaggttgcggtgagccgagatcgcgccattgcactctagtctgggcaacaagagagaaactccgtctccacacaaaaagaaaaaaaaaagagagagagacagcaactcaggagttaagtccattttctatgaaaatatatcgtcttagaaccatatcaggttttcctttttgcctctgattataactattgtattgacatctttgaaaacgaaagggagagctgggcccagtggtgcatgcctgtaatccctgctacttgagtggctgagatgggaggatcacgtaggccagcagttcaaggctgcagtgagctatgatcacggcactgcactgcagcccggacaacagagcaagaccctgtctctttaaaaaggagtagggaagggctacagaccccccatcatgtgccaaatactgtgttacataccttcatgcacactttcttaactagaaactcagctggtcaacaattagatcaacagatactggcattattttcccatagtgaccaatctgtcttctgtgtttacttcaatcaatcttccctctgggcctacagacaagttttctctctgaaatattaaatctggtaaccgtaataatgaagcagagaaaagaggaactcttggaaatgcactacagatactccaccaaacaaactctcattttatccataattttccatttttttccagcaagagttgcgtataagaagctataagcgacagtgaacaaacaaatggttgcagggaaagcataagggagctaggacagagatgatctgcaaagctaaatcaatcataagccagaataatggagcatagactgtgtttctggttcactctgctgctttgatctgcagtccaatgctctacctctgagctataccccctccttactctgctgctttgaatgtccttgagagaagcaataggaaagtgcctcctgatggtttacagtgttcacctgcttcggtaactgctaattttaaaccagaacctacagtccatattcattaaagaagagctagcttaccaacatcattcaaattcaggagataagattggccagagaaagcaggtttatagtttttcacctggagaaacacatttgttctgcagctgtggaaagcaatgacatgatggcccatagatgtctctctcctcaggacatgcctcactgcccctctgctagaaacctcctaacacttctccaagtcacacctgggcgatttcatcatgaacctaacctgtctcttctaagttggcaggaagacatcgagggccagaccaaatatagatctgatcctagtgattgagttctcagttcttgagtttactgagccccctgcagaaacaaacaactcaccaaacttccactgcaaacagcattgactttcatccctctgagctacttccagcagaaattgagcagtaagagggaagaggggaaagaaagcagtggctatctggaaggttgatatcattgcttgaagcctctaggctatcaaaacaatataataaagacaggcctctgtgaacaccatgtgtcagcctctaaaaggacatacattcattatttacataatgtgaggtaacatgttactatatcaggagttttcttattctatattctatattttatatattctatattagagtcatcttcaaaattataacagcagcaaagggacttgttgcctaattaaaacccttaaaaatgatgaaataaaatattatgtacgtcaaagataattgaaagaggaaaatatgcctgaactgaactgttgttacggttgattatattagaacagggtttctcaaaactggactagaaacttctgagagattatggagggccatagcaggacatagcttatcaaatacatctttcctgaacttgggtcagcaccttcaatgtggtttaccctcttagacttcttaacttagcagtttttacacacagagactccataaatagaagagatataaattttcacctagtcccctaacccattcaacatttccaacaaatggctgaatacttgactatttctagcaatggtgagttcattaccttccaaggtggtatgttccatgttcagtcacagagttgttaaaagttcatcctcatatagagttgaattctgtctccctgtaatatcaaccaacagtctctgattagtttccttggagccattaatacaaatatgagtgaactcaaaagagcccttcattcttttgaaaatacttgtcatatcagccaggcttatctcttctcaaggccagccttttgttgttccttctattcttgttccttttatgcttcctcatgtgttgtcactttcaggaacattcaccaccctgggagggttcccttgcccccaaacttattctcaatctgtcctgtttgtatctcataatcctacccctttttctatccagtgacccagggacaactgtttataaattggaatatcaatgagattctctctttcaagaattcaaacagaggttctgatacgctaattagatgacagtgaggacttgagttgaacagtttcacatagagctgaggcggtgtgggcctgattggaacatgaatgattatgggaacctggtaagagaagagcagaaattggagagagcatgagccctgagaaattgagaacactctcacttcctgacttgctcattggagctcctgggctagatagccctgtgtataccatcatgctaacatttattgagcatacactatataccaggcatgtaaacttttaatgtacatttccctgaatcttctcaaaaaaccctctaaggaaggagatatcatctctattttactacaaaagagactgaggcacgtagtaagtgacttacccagttcccacaatggttagtggcagagccaagatttgaaaccagagttttcgctccagagcccaggcttctcacctttacagggcattgcttccctatccttggaaacttatgagattatcttacaataattttcttataataattccttaaagacagttccatttatttaagctactatgagtgagtttctgtcctttgtaacaaatcttccgcgattaagatgccagatggttaaaagataccaactaatggccaaatggcagaggcagtgcattttgtcatgttattatagaaaaaaatgccatctagctttccttcaattgccttggcataacattaccttttccatagtatctggtggtctgttcctttgccagagcagatatcacattatattatagtcatttgtctgtatcagggtttcccaaccttagcactgttgagatttgatgctagataattcatgctttgtggtgggggctgtcttgtgcattgcaggatgttcagcagtatcctggcctctatccactagatgccagtaaaacaccctctcccagttgtgacaaccaaaatgtctccagacattgccaaatatcccctagggggcaaaaatgaccctagttgagaatcactcgtctacatgttctagatcctctccactaatcgcacactgacttcaagtgcaggattttgtcttctttatccttgtttctgtccaacgcttggtacattaagataatcactcttaattgaaaaaaaaaaaactatagttgcttgcattaaagtggcgttttgtagttaaaagtctggagtaactgtacacctgtatccatctgggtatagtcatgaagacaaagacattaaaagtagtaccaaaatcaagggtttaatatagaaattaggctttatatgaatgtgggggagtaactgggggggttaaggtctaaaaggcaatagtcaaaggatgggacttaacatgaagttctgagtagaaaaccaagtgttcacagaaaaatctgagaagtcaccaggtctaggcaccaaagtaagatcataaagtgggagtccacagaaaggtctagccaccgtgtctaacaaagcagcctcttctgaccccaatgattcccaaaagtaatagcctctgcttcctttctgctttccagatcttccaagtttctcttactgaaaaatcctaacctgcaaccaatccagaagagaattctgggaaatatagttcttcccagccttaggcagatgcctaaggagtggtggtgccagataaacaacagataatcccatacaataaccactttggcaccaagtgtgtggatatatatagagagagaagttgaagcacgataaagatctagagaatttggcagtcagaatcatccaagttagtaaacaagcaaatgcttgatgtgatttgtcactgatgctgttattattgttttgagtttagtagtgggttcatcccctaatcacctgacccctccagtctcaacattcaccttgcaccctgaacagatggcaaatgatattaataatcaaacagctcatactccagatggaagatgttcaccttcatgcttcttagaattttgtgtgtcttttgagcactctagctagagcagaattgacagaaactgctgtgaaagaatttccatatgcaaggcattgcttctcttatgaggaattgaaatatcacagccatattatccatttctaaactactctctaaggctacagatgacattaaataaaaacatttctgcttgatagattttgaacagaaagccaaacaactatttttaaacaattacttctagtccatttaaaatgtggtgctgtaggtgaggtatgatccaaagaagagtgaaaaatatatttcactatagaaaattctattcaaaatatacattgaaaagacaaagacttcagagtttgcatggcccacaaagcctaaaatgttgactatctagccctttacagaaaatgtttgctgactcctgggctagagggagaacagcaggagttaaggtctgagaggtaaaggggatgttacaaggacttatgaggagaaccactggagagttttgagctgaagatgacctgatttgactggaaatttaacagaatccatttatttgctatgttgaaaatagacactattgttgggaggacaggtctagaagccagcagaccatgtagatgactactgcaataattctggtgggaattatcctgatgagccaccaaggggtggctcagaccagcatgtagtgttggagatggcaagaagttattaggttctggtttgaagcttgaactgattctatttcctggtttgaagcttgaactgattctatttcctgatactagatatattgcatagccccacataggtgtaggggaggctagaatattcagactttccacgtacacatttatgaccagccaaaacaggggttctcaagtagggttgatttactcatccaggagacacttggcaatgtcttgagacatttttggtgtcacagttcaggggcggggtgctactggcatctagtgggtaaaggccatgtaggctgctaaacatcctgaaatgcaaagctcagttcccaagaacaaataattatctagccccaagtatcaatattcctgcaggtaagcaaccttgaactaaagaaagatccaccattatgagaagaaataaagaatgggttttggtggtaactaggagttgtatagcccaactcaactccctatgccgccaccccagccatttacaggctgtggcaacatcagttccaagatttctgctcataccacaactgagttctgtttgttctcccctgcccatacattttccccactactgggggtgaagtctgtcatgaataagaggccctactggcatttttaaatgcatgaggcttgtaaaaataacatgtgtgatcaaggcaatgaaggtgatgttgtataatgatagctaaatagtacaaagcaccacagtgcaggtattaatttgttttaagagatttatgaagagaatattccattaattagaattttaagacttaaaaacggatgtttggtaattactatagatttacagggattttgctttccttgctaaacccaaatgaatagaatatgagttcaaataccctaatgttatacaaatactccttagtcttttgctatgggtgttaactgataagatcgaaatttatttggtaaaatatttgaatatatctaatatgtattgacttttaactagctttattattttgaattgtaaacacatacataaatgaaaaaaagtctttatattctaaaatttttgtctattccatttgttttccttgcaaataagtatgcactttcttttaagattcttaacagggtgaatctaattttcacactatgtggctgctcacgagcttaatacttggccaaaaaaatggacggtgtttcaaaaatagaaaacctcagttattgagtgacattgttaagcttaggtttgccctaattttatataaatccagtatgcaaaaataagccatatggtaaataagcaaggaaatgacttttcaagttacaaaatacttttttcatattaccattcacttaagcctttactttatacatatatgcattcaatgtaggaagattcagccaagtattattctaggcactggggatatcaaaatatgtcagaacgggcccctgcacttgaaagttacatgaaagaggcagacacgtaaatagttgaatttaatatgatgcagtagattccattatggagacatgtactacaggaggtaaggaggaacccatggctcaggatcaggggtcaagaaaaggcattctgaatagaataatggcagagtagaatcttaaaagacttgaaggagtttaccaggtaaaaagaggtgaggattattctatataaagggaagcagtttatagtcaaaggtcatgtaatcctatgagagaagtaggtgtaaggcaggacatgggggtccttgaatgtcacacaaaggagcttgggagtggtcattaaggagatgagaaactgttgaaaagtattaagtcttgaaatggaagcaatggtccaacggcatctattccactaaagtagaaggcagggatagctccataatctgcgtagcacagtgcaaaattaaaatgtaggtcccttgtttaaaaattattatgaatgtcaacatggctatagcagagcattaagccaagcacaggacccttctaagcactgggcactgtgtgactgtatagtatgcatactcacgaagctgaccctgtcagaaggtctcagggccggggttgaaagaagacaataaaacccttatttgcatgtgtctactccctggttgggaagaaaaatcttaaatatatcaaccagctagagattagtctcaaggcaacatactagccagcattatagtcctatacccacaaattcagaaaatggccaaatgtcctatctcttcattttaaagatgaggaaattgaagaacaaaaaaaaattgagggactgtcccaacctcacacatctaggttatagtaaagatgtgaattcaaccaaagcctttcagattctagcccagtgatttcctctgttcctctgcaatatccagtctatttaaagtgagtagaagaggatggaagtcctttgagggaagagattgatccagaggctgcagaaaggactacaattggtaaagagagagttatctgccaggagacaactgctgtcctctcccttcccccagggagcacgacttttctgtgtccttacttagaattaagaggatcactacaaacacaattattgagtaatgattaggaaccaggcaatgtactctagagaatagggctacagagttaattttgacatgctcccaggagctcacccctctggtgagcaaagataatagtgaaaatcagctatcaaaacccagagtccttgggcatctatcctttaatatgaatgggaagcaatattaaagaaaataataaaaagaaaaatggaaattaatacctaaaaccaataggtaactagaaagtctttttcagaataggagaatcatggatgatttgcacatcgccttgtatgtctcagcagtgttaccatcagtaccttcaccaactctggagacttcaggctaaactgaaccccaataaacctttgtacatatctcaaaaatatgcctcctattatactctatttcgttatttatgcccccttcaaaaaaagcaacaacaaatctgacgtgtccaaagtttagaagtatatcttaattatgtgcttccagagccaagtccagtgcctgccctataataggagcttctttattcaacattactgccgatggtcaataaattgaatggattgacagatgaggtcagtgtaactgggggcaccctccaagtggagggcctgggtacagagagaagctttcagtgcatcaaggtgagagaagcagggtcagccacatccaagagatacttctgccatttcactcttcttttatccttctgccaatttcttcacttaagaaagtaaaaaaaaaaaaaaaagtagatatcaagtcctttacctaggcttaattcttatatatactcctacacacagttttacctctcattgatcattttaaattgaaataattaaactaccttataggacacgggctcacttttctaaccaggtcaggttttgattgcattcattcacaatctttacctgtgcataagcctgctctaatatttatttgtagagatcatctttctttcttaagtttattttgtcatagagttgtatatagttatgagtacattcaactctgtggaatgcagatattatagaaaaggttaagtataaatcactttatatggagtacatcatgaattagatgagcttggatttactagcaactggaagatccttctgtaaagtaaaaaaaaaaaaaaaaacccatcggtcaataaacaaggatttatcaagaattttttgagcacgcattagattactcagttatgaatccaatttcaaagaaatcatccactgatttattgcttttatatggttcagatacttattttgaaaggaagcacacttgtgtttggttttataccagaggagagataggctgatgagtaaatgtgattctctgaaatggtacccctgagaatgtcgtcgggtacgacattggtttcctgctaatgtatcattactgagatgaagtcaagatgtttatttttcaagcagaagttacattctctatcaatatgacattacattatagtgctgctagttcttcagggatatgattgattcctatagtagggtggatataggagccttaggcagtgatgctgtatctcaagtgactaagataagatacaggcagctcactgcacagagagccactagccagtttacctagcatgacttacagagcagttttcaccaacactgtacttagactggcatttttagtcctacttttaaatttgaaaagccaaccagtggtcaatcaggaacacattcaatcccatatatttgtaatatttatcttactttatggcaggaattctaggtttagataactagctattgaaagtgtaatatttggcacaacgatgactcaaatagcctgttccagttactgtgctgaataaaccacttcaaacttattggcacaaaacaaccatcttactatgctcaggaatttgtaaaaggcagagtaggaatgacttgtctctactacatgatgtctgacatattagctcagacgattcaaagacacatgattatttgacagctaggagtcagtcatctgtagacttgtttgtccacatgtctggtgcctaggctaggaaaactctaagactaagactgctcatcagagtgcctacacatagtctttccatgtggcttgacttcctcacagcatggcagcctcagggtagttggattttttatatggtgtcccaagactccaggcccaagtgcaccagtgaacatggcaaggctgcattgccttttatgaactaacattggaagtcatacagtgtcatcttcactgcattctattacttacaagcaaacataagcctgcccagattcaaagggaggggacatagacccctaactctcagtaggaagagcttcaaagtcacaatgaagaaaccatgtgaatgggacatattgttgtggccatctttgacaaatacattttgccacagtccaccctcttcgcacaacaattcacatccctcccacgtgcaaaatatgctcactcccttttccaagaccaccaatattaaatgcacacctacaggaatagtaaaatagaaagctgttttttgttattggtgttttattttattttctgggtaaggggaaataattaatgacctataaaagacttcaatgggtgaaacattgattacaggtattgaactaaaatgtagctcaacctgaagaataggagaagacactttcaaactcttcatccaataagggatcaatatcaaaaatatacaaggagctcaaacaactcaacagcaaaaaatccaaataatccaatttaaaaatggaaaaagtatctgaatagacatttctcaaaagaagacatacaaatgaccaacaggtatatgaaagaatgctgaacatcactagtcatcagagaaaagcaaatcaaaatcacaatgagatatcatctcaccccagttagaatagctattatcaaaaagacaaaaaataacaaatgctagcaaaaatacagaagaaagggaactcttatatactgttggtgggaatgtacattaatacagccattatggaaaacagtatagctcaaaaggctaaaaatagaaataccatataatccagcaatcccaatactggctctatatccaaaggaaaggaaaacagtatgttaaagagatatctgcactcccatatttactgcagcactatttacaaaagacaagacataaaatcaacatacatatccatcaacagataaatggataaagaaaatgtagtgttcatacataatggagtactattcagtcttaaaaaaatcaaatcctgtcattaatagtatggatgagtctggaggacattatgttaagggaaataagtcaggcagaaaaagagaaatactacaatttctcatttttgggagctgaaaaagtagatctcatagaggtagagggtagaatagtggttactagaggaagagaagggtagaaaggagtgaggaatagggacagtttgattaacagatacagaagtacagctacataagaagaacaagtttcagtattctatagcactacagtaaacaataatttattgtatttttttcaaagagctagaagagaggattttgaatgttatcaacacaacacagtgattaagttttgaggtgatttatatactaattaacttgatttgatcattacacattgtacacgtgtattgaaataccacccttacctcataaacatgtacaattatgtgtccattaaaatatatttaaaaatttaaatgtagctcaaaactcaggatctcatcatgtaagtcaaatgaagcatctcaggttaagcattttggatacagttaaaaatgaaaacctgggaactaaagagacaaggtatctgctccacttactcaacagacaatatggagacatacagaggataactgttatagactcttccattcaaaaatagggggaacaagaggcacacagcagtcactagttaacaggaattctgagacctagaaaggtccatgttggaagatccttgtttgggggatatattccttggttgtcctctctagtttttgggtctgctctctggactcttattctgctatttgaaacatctttctttttctataagaaggggcacttgtttgccactgagtaacctttttagtctatttattgtctttaaaagattaggagtctaaagacctcctttcattttatactatctttgttgttttcagtccaaacatacaattccttaaaaactgttgggggcagggctgggcatgttggctcatgcctgtcattccagcattttaggagaccaagatgggaggattgcttgagtccaggagtttgggaccagcctggacaatatagtgagacccccacctctacaaaaaaattagccagacatggtggcacatgacccgtccaccttgggaggctaaggcaggaggatcacttgagtctgggtagtcgaggctgcagtgagctgtgatcatggcactgcacttccagccttggtgacagagtgtgaccctgtctcaaaaaaaaaaaaaaaaaaatactgttggggtttatatataaatttataatccacttcattagacaaaagctatactcacaaatattttcaagataaaccctgttttagttaggaggattacgttttagagatgtattgcatagcatggtgactatagttaataataatgtacatttcaaaattgctaaaagaatagattttaagtgttctcaccacaaaaaatgattagtatgtgaagtaatggatatgttaattaccttgagttaatcattccacaacaaaacactacattatactccataaatatatacaattattatttatcaattataagcccttgttatcttaggctccctgtgagtatgctgtgtggcccaacacccttaatattcgtagaagcttattgtttagaggagacaatctgtaaggcatgttcttatgatccttataagacctattgcctgtctgaaagagcttatcaggtactgctttagatatttctcaggttttaacaaagaatcgtacagtcccaccctgtatatgattttttcccctgaggcctgttctgatttgaggacccttcgcaggctgaaaagacttattctggatcctttacatttcctccaacttctacttggacacttaatggcctgttcttcagttctttgtcctctctcagtttggtatcagcagctaaaagccaagcagcatcctcagtgctctatctggaaatctccttaggtagatgatgaggtttattaagtatattttctattttccatgttaccacaggaaacaatgttggtaaacttttccccatcctccagctttccacagcaattgcctttctttcctcccagtcttccaacaacctccttgagggccttccagcttctgcctgctgcctggtcccaaagataatgccacaacatttcagtttttgatacagcatcaattatctgtgtagctatctattactgcataataaatcatccaacatcttagtggcttaaaacgataacaagcagttcattatctctcacactttctgtgtgttaagaatttgggaagatctcagctaggcagttgtggttcggggtctctcctcttggtgcagtcagacagtaactggggctggaacagctgggagttgggcaggcatcattctttcttcatgtactcacagggcttttccatgtgatttctccacatgggctactttgagttcttcatagcatggtggtctcagggcagtcagacagttgacatggtggctcatggttccaagcacaccaggattggagcttcatcactttttatgacctagacttagaagttacttagtgtcacttccaccaaattctgttgattaggagcaagtcacaagcccacttagactcaagtggaggggatacagaccccatgtctcaatggaaagagtgtcaatgataatactgttaagaaaaaagcatatgggatgggagatattgttgtggctatctttggcaaacacaatataatacagtctgtgacttctatatgacatatggaagcatgcagaggagaaagaagtgggaactgcttctcttctctttgccttgccaacatgccactatgctatccacagaccagtttgagagggccctgcagaatgagtgtaggggatcccaccagctgacctaaaccatggctactccataaagcttcctttggaatacttagctgacatgcagaatgatacttataatttcattttatcctcagcatcagagcaaagatttattctgaatccaaaattatttacaagtattgccttatctgggtaaaacttgaaaagtatttaaaagaataattttaactgtattggctaatggctgattttagcataagtcaccttcagtattttttgtcttgcaaacagtttggggttgaaaagaaagactgccagtcatgcattaaaatataaccaagtgtatgcctccagctgagatctctctgagttacagactgtccattgcaatcaatcacctaccccatgtatctattcgaatgtctcaagtgcacctcaatcgtattattttccccaaacttaatgtgatcctcttttggtgtcttctttctcattgaatggcattaatatccatctagtggtttaagctggaggttaaccttgacaatttccaatccatctctaagacctgttgattgcccctctatgtctctagttggcacattgctctctacctataccaccacccattaaatccaaatcattatcatctctcatctggaccattgctgtagctttgtaacttcttggattcacttttgcgttcctctaggcagtcatccacatggcaaccaaagtgatttatttcaatatgctgatctggttatgtcatgcaatctccattaaaagccagttatggctccccttggttctcaaaataaagcttcatcagacactggtttacagggccctatatgatgtagcccctggttcatttctgaaacattgtctcactccacactccccctgtattccaggcctcagttgcatccctcaattgcagcaaaccctcctatctcagacattgccaaaccctgccttcacctctttaatgcctctcattttttaaatctctaatgaaatatcacttcctaggggaaaagcttctcttatctgtcagattagaccaggaccccatttagtaagctctcatagcatcttataattttccttcagagcccttatcatagttagtaattatgtattcatgtgattactttattgtttcccttcatctcaaggttgcaaactccttgaaggcaagaatcaaatctattttgctctccactggatccccggcacatagcacagtgcctggcatctctgcaagccttttccaaccactcaatctaaaacactcccttctatgccacttgcctaagtctcttaccttaactgtttatttttttccaaagcacccatcattatctgtgtgtgtcttgtgtgtatatgcattcgtatatgtatatgtgtgtatatgtataaatatgtttgtgtgtgtgtataatttgtttacttgttactgtttccccctctagaatgtaaattccaaaaaatcagagacttttgtattcttgttcattgctgtaactctaccacgtacctggcacataataggtactcaataaatatttgttaaaaatgtgagaaataagccaggcatggtggctcacacctgtaatcccagcactttgggaggccgaagcgggtgcatcaccggaagtcaggagtttgagaccagcctggccaaaatggtaaaaccccgtctctactaaaaatacaaaaattagctggacatggtggtgggcacctgtaatcccagctactcgggaggctgaagcaggagaatcacttgaacccaggaggcagaggttgcagtgagatgagatcacaccactgcactccaacctgggtgacaaaagcaaaactctgtctcaaaaaaaaaaaaaaaaaaaaaaaaaacaagaagaagaatggcagttgctcaataaataaatcctggaagtttcttctttaaaaatcaatgataaaaatatgctgcactgagaaagagataatacattgacatgtttttcttttggaaaaattgcctttcacaatctgcccaaaatgacactttgacagttttaattcatttcagcacatgtcattaagcaacaaggggctatatttggtttagtttatttcaactttgttgttctgcaaagctcagtcagattcttcattcataatcttgaatggaagccatttgggatttgataatggaagccatttgggatttgataggggcaaaaacgtacacaaatcaaacccagagactttggaatcagttttagaatcagacagacctggatttgaatctcagcttcaacatttattagcactataactataggaagccacataacttttcttggcctcagtttccccaagaaatatgtgacttgaaagatcaattcagtaacaggactgaccatggttttaagtgaatggtacagactcttaataaatgctatccatttattattcatgtctattcccaaagtacccatgatacaaaggaggaaattgaagccttaacagttgaagaaaatttcccaaggccattcctcttatatccaggtctgtgattaagcatcattcaaccatcatttgcttgggagattttttcagtgaaaacccactgtatttggacacatattgcttcctaagacagactggagagtccattatgtccttgcattgagtgagactcactacaaccttcagttccaactgagaaatttcctgtcccaacagaaaggaggctcagtccaataaaaaaatctgggtgagaaatgcgatggaaagatttttaggagtccttttacttcctcctttctcaagaataaaagaaaaattacaaatatagactctgctaaaatcttttcatctgtaagtgccatgttctttaattatattgaaatcatttgcttatgacaaacaattcactacaatgcaactccagtgagctttaggtcaatttcccatctagacaagaattattctaaacacaggaatgagcaaattttacaataagtaaaactgatgcataaaatacataaaattagataataaatttcaagcaaattgcacagtgccatggcagtgctttatacagcagacgggattaaggagatcttatcaaagtgcgatataaaaattgcatgtgttgaaaccttgactggatgattcattttctgtgagaatttaactaatcagtgaataacaaaagagggtcagctagaagtgcttattgctcagttactaaagatggaagatgatggataattaattgagtttctggctaatcagaagaaatggagaatatatgcctaaaattaattatttccttactggaaggacctaactgagtctacctgtaaatatgctcaactcagctgtggctacagattgttctttattttagtttcagtttatccatgactcaagctcatttcatataggaatcttgtcatattaccataacattttattctgaacctgctagaaaggcaattagtcatttattataacacaaaaaaattcaaattggttgcagttatgttttcagaatcaaaaccatctcctttgatgtgaataccataaagttctatatttaaaaggcattgaatgcatcataatggtaaataagaagacccttaaactagcattcatacctcctgcacataaaaccttaaatggataatttttactcacaacaggtttatttttgtggcagagaattttaaagaattgattaaattagctataactatgctcagaagcataatttgaaatagtgttgaatgaatgaggaaagtattttcaagcatagggaaaaccctcttaaaattcccttttgttcattattcagcaaacatttattaagcccccacagtttgcatgacgatgtacaatataatgagattctaacctgacatccttctattctagctctgttaattgaatgagttaatctttttagctgtccattcacagtatgtgatgaaagactatagaaattaaatgaatgagtcaatctgaaaagacacgtggacatgtatatttaagtttccttttgtgtgctaaaaatagtttactacctacataccctttctatttctttaggggcttcagaatttaaaagaacattatcttactgaggcggtgaactatatgcttaatcatgagtttctaaaggtttatagaggtgagagctgtaatttgcaagattctgcagatacgcaaaggaaaaaaacagcacagtaaatttgagcagataaggagaaaggtattttgaggggttgtttctatttcaatagtaactttagacttaaaaatatagaataggttgtacattttagagatggacatcggaactcatctagaccagtggtttccaacattttacattagagtcactggatctttaaaaaaaatagaccctaagttctcatccccagagactggtctagaaagggctgggaggggaggcaggcatacatgtatttgtaaaagttccccagcagccagagctgaaacccacagatcccagctcagccttgacattattggcatgaggtccctgaggctttgaaagaataagtagcttgcctaaggtcaacacagcttataagccttggagcaggcacagaacagaaatatccaaattcccagagcggatctctctttactaaaccaactggcatcatttctacttcacactggttgagatctaattaccaattagtagtagttgggaagtccaagactgcctataacaagtcccctcctcctaatgacctgtatgtgcttccttttcttgctaagcactgagtaagtcttcagatagttatgaggacactgatgacactgtaataattaatatatccagttattccacattttgaaaggcttcacttatttaaaacttttgcatccataaaatattcatatttttaaggcaaagaaaacaggtttaatatttgaatctgagtcccactttaagtcttcattatcgagtttatataactgagcacatggaagtactccgatgttaggctggattttgtttgctgacttccttatatgataatacctttagtttggccccttccaccagattctgaaagttccatgcagatagagcccttgtccaacttcatcaattgtctcccagcacctagtacaatgcttgtcacagaggcaacactcaacaattaatggttgaattaaaaatcctttattatattttgttaagaaatgagacagagtgcctttagccaacttgtgtaggataatcccatataaataaaagtatggaaagatggctttataaagtagtagttttatagttactttttaaagacctttggtctgatttttgtgatataatggtctgattaaaggttacaactaggccgaggcaggaaaatcacgtgagcccaggagttcaagaccagccttagcaacatagtgggaccccgtctctacaaaaagttaaacaaaaaattagctgggcatggtggctcatacctgtagtcccagctactcaggggtctgaggcgggaggatcacttgagcccaggaggttgagactgcagtgagccgtgatcatgccagttcaccccagcctgggcaacagagtgagactgtctcaaaaaataataataataaaggttataattaattttttattggaagcactaggtgcagtcattaataaaacctactaatgtatcaagcaaatgaggtttctgttttcccacctgattttcctagagatcaaatttacatggcgaaggatgacatggaatatttggcaattattcacacttgctatctctccagctcaaattccaagtcattgccaggttgcaatggaatgttcagccatgtttagggctggcttcaccagagatactgtatcacaatgggcaatgtcgataaatcaaaagcctcaaggactgcgttgaactcttcttcattttcaggctgcatgtatctcccacaaagggaggtggcacctgggtactacactaatttagctaaatgagccacatagaagcaaatctgttctgccttgcaggttctgcagcttcccctctgagcacgtatactataatctaatctacctattctgaagtccttgcaccactctttaaactgttacctgctctttcactccccattttgcacatgatcaagtgtaattaactgaaatagttcttctcaccttccttacctctccagggatctgctgttgaacttacaaaactcatttaagtacacaaggtacaaattgtccttgttgtaccatttgagttttacttaggctgtcattcatattataagtccttcatttagtataccttttatatgtggatgaagacactactgacattcagtaagcattaatgaaataaagttaataccaagtttccttgtcttttgggaaacataaccattattattatctggcaagataaagagtttagtgcctctggtgactcagaggagttgcatgttattgtggaaggcagtaatctagttacagaagaagataattcaattgatggctgtttacagttaagtcatttcaatcccagcttttcaaccccaccttttcaaccccaccgtttgaccccctcctttgacccaaacacatacccagatcccatacatttttctctaaggctatttgtcctttacaccaaggaataaatacaatttttcagacttttatctaatttatgtagaaataatcatacaaatatcactgacatcagctaaaatgacacatttaaatatggtagaaatgattcaccagccaaataatcaatgttaaaaatcaacactggaaaaattaaattattaatgaatatttaatctctgctatataaatgagatgaactagagggctggagggggaacaggtatatatataaggggctcaccttagatgtaacatcaacattaaacctaatgttaatgggggaattgcgctgtgaatgaaccacaatactataggttccttagggccaggcacacagcacaggctcagtaaatgttttctgaatgaatgaatgaatgaatgaatggtcctcttcatagacttacagtgtaacactgggatttggagaactgctttaaaatctctattcatatctagggattaataaactagattttgggaaagtcagtactgaatataatgtaggtgtttctgtttgttaattaattaaaatgaccacagtcattattcttacccttaatttctcagtctgaaaagttaatcaactgtatctgttccatgaataattgagttgaacttgaaagagaactcgctattccaaaagcctcccacaccaccagttaactgtgatttatccttttacttctaaagaattttaagcatcttccatctaacttgactgacaaccaatctgtgcttcctctgtctttattccgtcaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgcaaa

SEQ ID NO: 4328 - DNA, 327 bp, human
atgtctggaaggctatggtccaaggtcattttgccgtctgtaagtggggtctctagaaccaaagggagcatacatttcttcttaaaattgaaggtgtttatgcctgagatgaaactgaattctatttgggcaagaaatgtgcttatgtgtacaaagggaagaacaacacagtgactcctggtggtaaaccaaacaaagccataataatctggggaaaggtaattcaggcccatggaaacggtggcatggtttgttccaaattccaaagcaatcctcctgctaaggccattggacacaaaatccgtgtgatgctgtatccctcaagga

SEQ ID NO: 4329 - DNA, 33927 bp, human; identical to SEQ ID NO: 3105

SEQ ID NO: 4330 - DNA, 34628 bp, human; identical to SEQ ID NO: 3106

SEQ ID NO: 4331 - DNA, 32240 bp, human; identical to SEQ ID NO: 3107

SEQ ID NO: 4332 - DNA, 32099 bp, human; identical to SEQ ID NO: 3108

SEQ ID NO: 4333 - DNA, 32612 bp, human; identical to SEQ ID NO: 3109

SEQ ID NO: 4334 - DNA, 206581 bp, human; identical to SEQ ID NO: 3120

SEQ ID NO: 4335 - DNA, 202322 bp, human; identical to SEQ ID NO: 3121

SEQ ID NO: 4336 - DNA, 75301 bp, human; identical to SEQ ID NO: 3122

SEQ ID NO: 4337 - DNA, 206410 bp, human; identical to SEQ ID NO: 3123

SEQ ID NO: 4338 - DNA, 206581 bp, human; identical to SEQ ID NO: 3120

SEQ ID NO: 4339 - DNA, 202322 bp, human; identical to SEQ ID NO: 3121

SEQ ID NO: 4340 - DNA, 169078 bp, human; identical to SEQ ID NO: 3126

SEQ ID NO: 4341 - DNA, 206410 bp, human; identical to SEQ ID NO: 3123

SEQ ID NO: 4342 - DNA, 60656 bp, human; identical to SEQ ID NO: 3137

SEQ ID NO: 4343 - DNA, 61185 bp, human; identical to SEQ ID NO: 3138

SEQ ID NO: 4344 - DNA, 61286 bp, human; identical to SEQ ID NO: 3139

SEQ ID NO: 4345 - DNA, 61286 bp, human; identical to SEQ ID NO: 3139

SEQ ID NO: 4346 - DNA, 61286 bp, human; identical to SEQ ID NO: 3139

SEQ ID NO: 4347 - DNA, 134447 bp, human
ccgagccaggtgtgggatataatctcgtggtgcgccatttttcaagcccgtcagaaaagcgcagtattcgggtgggagtgacccgattttccaggtgcgtctgtcacccctttctttgactaggaaagggaactccctgaccccttgcgcttcccaagtgaggcaatgcctcgccctgcttcggctcgcgcacggtgcgtgcacccactgacctgcacccactgtctggcactcccaagtgagatgtacccggtacctcaggtggaaatgcagaaatcacctgtcttctgcgtcgctcacgctgggagctgtagacgggagctgttcctattcggccatcttggctcctctcgatcccaaagattttttaaaaaaatgtttcacatttaggtgcatgatacatttctaattaattttctctaagatgtgagaattcggttgaggggattttttttttcttggccttttggctaagatcaagtgtagaactaggttgagatttatttttttctgcatatggatgtttaattgttccaataccatgtgttggaaaggctgtttttcctattgaattacttttgcatatttgttaaaaaatcaattgggcatatttgtgtgtgtgtatttctatattctctattctgtttcatagatctatgtgtttatccctctgttactattacactgtcttggttactgtagctgtatagaatgtcataatatctgtagagtgattcctcccattttactcttttttaaaattgtttcttttagctattctaggtcctttggtttttcatataaattttagaataactttgtctgtactataaaaatccttactggaattttgatagtcattgcattgaacctatacttttcaatttggggagaattgacatctttactatgttgaatcttttagtgcatgatcatggtttgtctctccatttatttaggtctttgatttctcttagtagcattttgtaatttacaggatacaaatgctatacatatttagaaaaagattatactgaagtgtttcattttctttagagtaagtgtaaagttattgtgcttcaaaattttagtttttatatgcttattgttagtatatatgaatgtgattatctttatatgtttatgttgcatctgtgaccttgttgaattaacttattagttctggaatttttaggagtagattctttaggattttctatttagacaattatgccatctgcaaatagggattgtttttctttttcttgtcaatctgtctatatcctatttccttttcttgctttattgtgcttttcagcacagcattatgtggtaagagtgaacatcccttctttgttcctaatcttagaggaaaagcattcagtccttcaccgtcaagtatgattttagctgtaactctttatcaaattgaggacattttcctctgttcctagttttctgagcactctaaaaaatcatgaatgcaccctgggcaacatggtgaaaccctgtctctacaaaaaaaaaaaatattagctaggtgtggtggcacacacctgtggtctcagctactctggaggctgaggcgggaggaatacctgagtccaggaggtcgaggttgcagtgagccctgatcgtgccattgtaccccagccagaatgacagagggaggccctgtctcaaaaaaataaaataaaataaaaattatcaatatgtagaactttcaaatgttaattatttttttttcggtactttgaaagtgatgcttggttgacatcttggctctgtgtgaagttctgagagtatgagggcacatcatttccctggtcagctctatccctggggtgtgctgggaagacacagatgagagtaggacttcttgttggatgggactaaggaaaaatggagaggagagatcttagggtcctgccaaatggactctgttaccaagttactcaacgaaaaacatggtactgtaagggttattagtttcctgttgttgctgtaacaaattaccacaaacttagtggcttaaaacaacataaattcattctattacagttctggtggtcaaaagtctaaaatcatggtgttggcaggaatgtgttccttctggagtcttcggggggagaatctattgccttgcctttttcagcttctagaagacactcacatctcttggcttgtggtcgttcctccatctttaaaacacaactccaccctctggttccattgtcacgtatcctttttctctctgaccttaattctgttgctccctcttatgtctacccttgtgactacgttgggcccacccaaagaatccaggattatctcaacatccttaacttaatcacgtctgcaaagtctctttgccatatatggtaacatatttataggttctccggagtaggacatgggcatctttggtgggggtggtggatggggggattatttattctaccacacggggtgactatgggcatgatgaggtattttaaagagcaaggctttggagttagacagaccgtggtttgacttcccactccagctttaacaagctgtgtgacttgcagagaattatttaatctggctaaaactttattcatctgcaaaactgtaatccctttgcttgtctgcaaaactgtggtggaaatgacagctgtttgtcaaaaatttacacccccttctgtagtatacagttgtggctagggagcaacttttccaggcaggcagtacatttcttagtatcatttgcctctaggtagggcccaaatgagactggttctcactcatcatatgtggctggaagtgatcactgctgggctaaagtacctatgaagtaggtgtgtattctttatgctctcttctcccatcttttggctccatactaactcccgggtgactttggaagcctaatgaggaagatgaaaaagctttcatcagcttgtgtctctgaataactgtgtgaagcagagtccatttaacgcagactcctgcgttaggctctatgagctagaaatacatttctattgtgttaagctactgaaaacttaggcttattcatttcagcagctagcaatacatctgtcttgcagggtattattatcccctggggctatacaatgaaatcacgtgtgtaaaacccatgtcaccatgataagaaactaagggactcagagattggaaagccgtcaactcttctgcctagagcagtggttctcaaacttgaacatgcatcagcatccccaaagggcttgttaaaacagatgctgggcccacctcaagagtttatgattctgggttgggactcctggtgttactggaaaggggtcctgattcagaccctaagagagggttcctggatcttgcgcaagaaagaattcggggcgagtccatagagtaaggtgtaagcaaggttattagagaagtaaagagacaaaagaatggctacttcataggcagagcagtggtatgggctgcttgacttagtatacttacggttatttcttgattatatgctaaacaaggggtagattattcatgagttttctgggaaaggaacagggaattcctggaactgagggtttctccaccttttaaaccatttacggtaatttctggatgttgccatagcatttcaaaactgtcatggcactggtgggagggtgttttagcacgctaatgccttttaattagagtataatgagcagtgaggaccaccagacctcacttttgtcaccatcttggttttggtgggttttagctgtcgtcgtcttcttcttcttcttcttcttcttcttcttcttcttcttcttcttcttcttcttcttcttcttctttcttcttcttcttcatcttcttcttcctcttcctcttcttcctcttcctcttcctcttcttcttcttctttcttcttcctgttttatttaactgagataattttattttatttcatttaaaaattacaggctcaagcctgtaatcccagcactttgggaggctgaggcgggtggatcacctgaggtcaggagtttgagaccagcctggccaacatggtgaaaccccatctctactaaaaatacaaaaattagccaggtgtagtggcgcgtgcctgtagtaccagctactcaggaagctgaggcaggagaatcacttgaaccagggaggtggaggttgcagtgagcagggatcgcaccactgcactctagcctgggcaataaagcaagactccatctcaaaacaaaaataactatttttaaaattaaaatttaaatttttaacttttattttaggtttgggggtacacatgtaggtttgttagataggtaaactcatatcacgggggtttgttgtacagattatttcatcacccaggtattaacccagtagttattgtttctgctcctctccctcctcccaccttccaccctcaagtagaccccagtgtgtgttgttcccttctttgtgtccatgtgttctcatcatttagctctcacttgtacgtgagaacatgcagtatttgcttttctgtttctgcgttagtttgctaaggataatagcctccagctccatccacgttcctgtctttatggtagaatgatttatattcctcttctttatggcatcctgttttatcagcaggatctttgtgacctgtatcttgtgctgacttcctatgtcatcttgtgactaagaatgcctaacctcttgggaatgcagcccagcaggtctcagcctcattttacccagaccctaatcaagacggagttgctctggttcaaacgcctctgacactggcaccctgtattatttcgctttaggcttagctctcttgcttgtcttttctgcatgactgtgacctacatgtaggcaggcactagtgttagacctagtctaacttgttggtaacttcattcccagaaccagcatagtacctggcaaatagaagaccctcaacaatactggaggaaagaaaaaggaacaagtttaacatcctcagcttcaagggttgaaatagatacagtaagcttcagttaaagggtttaaagatttcctcattcctaaataggcttgcttgggcttctttgcttctccaccaccctgttaagatgagaagttgcagcggtaatttgttacctgttaactttcgctggtatctcttggaagagcttctgggattgatcaaatagcttgcatccattctatctagccaaatttattttgctttcgcattctggggcttcagttgatcatgcaggaggatttcatttcagagagctgctgcccatttgagaaagtacatgaaatagattttctctcagcggggcttccctgcagaatataaagcaaggcgttcgcagcaatcaaccctcagttctccagggctggccccacatggaggctgaggaggtagccttcttctggggtgagaggaggtcagggaggggccgcagcctcggaagtagctattaaaaagcaaatgttatctagaaaagagggagaggggttccaaagagacaaattgtgtgtacttggcaattttgcctgtggcagactctgaactccgtctctctgtgaagtgaaaagtttggcattagcaattccaaagagtcgttccgatttcagcagctgaaagtggactgggggcaggagggttggcagtggacgccgcgggagttgctgtcagagttcccgggcagcctgcatgctttcatccaggctggtggccgcgggaacagtgtgggaatgccagcagcaatggggaggcaccagggaggagggcgggaggctgctgctgtcccggcaatgaacagcggcccgccccctaccccctgcaaccacgaactctgacaaggcagagggggccttcctagatcaccacccacttgggttgcatttagaggcccgagctatatctgatttcaatttcttgggctaatttataccccactataaacaaactcttgtaaaagttgaaaaccagcaaggataaagaagctgtattttcattatagttgtttttcttctgatgggtttctgaagtgagttttccaatagcagagaccccaaatttttggcctctggagatctgaaaggtgctatattggggaggaggtgaggggggcaattcagcaagagctggtgcttggctctgtgctggggtctttcactagcattgaatcaggggaagggggaagttttgcccctcttttccccagggccttaaagtttgacagaaattcacagaatggtgcaatgtgggaaaatgtaaacatgtttataaaagtcgtctgtgtggccaggctaagtctcaaactccagtcagttgctacctaaatctctttgttaagctgatgtttccagatcaagctattttgtaattctagctttttattttactttgggcatttggggtgatttggtgttttaagtgttaattttctgaaagctccattttctccacttcaaattgttgctaacttgggatccagtatgatatttattaacctcaagtaaactgctaagaggagcctgatccgggattgtcttcatccttttgtgttttgtttttattttctaattttcatttcagaactttcagaattggttttcccaccttttcagtgctagatctgccaatggtttagttcatttgtaagttcagttctttatgtcaccatctagtgttcactgatgtcttgtaattgcgggggatttgtgtctcaaaagcttaaaatgagttggctgtgctttaattccaagttctttctttcagacatggtagtaaaaatgagaggttactaagtaaacattacttttaacatatatatgtaagtggattctgtgtttatgattgctgcgggattacctttaaatgttctctttcagtctctagtcaaaagtagtttataaatagttgctgtggatttggctccttaaaaatattccagtagaaacagattatttttaattctaaagtttatgccagtagcaatttgccacaggaatagattcttatgggggcgctgaatgcacatttgagttcacacaaaatctatgaataagttagaaaagttggctgggtgcagtggctcatgcctgtaatccaagccccttaggaggctgaggtgggagaattgcttgagagggggagtttgtggctgcggtctaagatcgcatcactgcactccagcctgggtgacagagtgagacaatgcctatttaaaaaaaaaaaagatagggaagtcgagggtcagtgagtgtctgttctgcctctggctcttttctcccacccagtatacccatcactcacttgtagataaagacaaatcaaaagctgtttgcagtcctttttcggggcctttttcacttgtttctgagttgccagatctgaagcttaaagctggtcctggcccttcctggagcttcacccctgattctgactacccatgcccagccggctgtagaaggaagctgagcctgagtctggcccctcaattaggggttagtcacttgggtagtgcctcaattcgtgcagaagaaggctgttatggaccaagttgtgttccctccctctctaaatccataggctgatgccctaaccccgaatgtgactgcatttggagatagtgcttttgaggaggtgatggaagttaaacaaggtcataagggtggggccattacgactggtgtccttataagaaaaggaagagacaccagagctctctctccactttcctctatgcacagaggaaaggccatgtgagcgcacaagaaggcggtcgtctataagacaggaagagagctctcatcagaaactgaatttgctggcactttaatcatggatttctactctccagaactgtgagaaaattaatgtctgttgtttaagccatatggtctatagtattttgttatggcagcctgtgctgactaatacaggtgcatagacccttttcccaaaagaataggctgccggggaatttctggttaggaaatagcagtcacaagggcctaggctattggaatgcagacccttattgctatggccacagcccaagggagtgtcaagaaaacccatttgttgggcctgaacagccagggagaggtctaggccacctgtggttcagagagatggactcagggccatcctaaggagatatatgaccttactgtaagatttcagggcaagtgtaaagaactattatatttgatgatagagaaaaaccgtggaaaataggatatatttatatagtaactgcttccagctagggatgtttgaaaagagtgtctaatgtatttttaaggatgttaatgtcagaggggtttgaaccagagcaactccttcttgaataggggctgggtaaaatgaggctgatacctactgggctgcattcccagacagttaagccattctaagtcacaggatgagataggagtttggcacaaaacacaagtcataaagaccttgctgataaaacaggttgcagtaaagaagctggctcaaacccaccaaaatcaagatgacaacgagagtgtcctctggtcgtcctcactgctacaggaagttactctatatggtctaaaaagaggagacatgaataatccactccttgtttagcatatcatcaagaaataaccataaaaatgggcaaccagcagacctcagggctgctctgtctatggagtagccattctttattcctttactttcctaataaacttgctttcactttactctatgaactcatcctgaattctttcttgcatgagatccaagaaccctctcttggggtccggatcgggaccccttcctggtaacattaacttttggctggctggaatatttcattacaaaagtatgttcttggaccttgctactcaagggaagatccgtgagcagcattggcgtcctctggaagcttgttagaaaatgcagggtcccagaccctgtacctgccctactgactcagaatctgcatttttaataaattccccaggtggtttctatgcacattaaagtctgaacatcaggtggtgctgatctcggttacaggtcactagttttgttttacctggcaggattctgtaagtaaatgaagtggcgttgccagatgcaagggagaggcagtagagctgagtgacagttgctggtactgtgcagttgtcccttcgtgggccttgtttatagtggggcttcaaatggtcaatactgagaaaggagtcatgggcctggaaacaggaaatggctaaggtcaggcacgagatgctagaaagacagtaaggcaaagctaagtcatcggactctaggtaagcacaaatgaggagctttgaatgtgagaaacaaggtttttgggacaaatccagaatcaacgtttgccataagcagagagagtagaaagggaattgataaggttatgttggtaaatattggtggacagtttttgtttacatggattcccttttgaaggctcagggttctgaaaggtctctgatggccttaaaggcacagaagtctgaacctgattgagtcattctattaaacaaggtgggtgtaggaccagagaatctgggtttgatgtgccaaggttgatgccaggtcgaaaaaccaggagaagggtgagcttggtggagttgggtagaaacagaggcatgaaaacaggaggtcacacagcgttgaaaacaaggtaaaggaagataggccaaaagccttgcatgtggggctcactgaaccccagtctagcgtgagcagggccaaaggcaggaagaaatactgcctgcatctggaagaaatctgcttgccatcactgggttcaggaaacccagtgtcggagacaattagaggaagctacagaagttacaggggagcccagaagcaaatggacaaaagcccgagttattggcctacctgcatcaaaggtcctacacccttaaagtgccggaaggtaccaaattcctgggagggaataaaacttcatgggtactgaaattagaaagataattatgcactagggatgacatcaatgtcactcctggtcacactgtttttcttctccatttctgaaagctacatagcatatcaccttgctactgaaagaatggttgaggaccagcaacaccagcatcatctggttgtcagtagtgcaaaatctcaggtcccaccccagacctagtgcatcataatctgcatttttaactggaaccttgggttatggttattcctttgcactttaaatttagagaagtaccagcttattgcttagcacacagagatcctggacatctgaatttgaaatctgctctgccaacaatttcctgtttatggaactctaagtctattacctggctctagagagtgacttattttcttatagggcagtggttctttactttggctgctcatgaaagtaacttgaagagcttcttaaaatacagatgaccaaaccccaccttggatcaattcaatcagttcagttgatctggagtggggcccaggcatcagcatttttaaatgctcctcaagtgattccaatgtacagcctgttgaaaacctgggatctagagtaagagggaagagaaggcagcagaggggtatctctgttgaaagggggaagtgagagttccagagacctcaaagtggccagcaggaaaaggatcctgcatcttgaggatcaggagttcagtggagagggctcattgctaagcattcctcaaatgtgaatgccccccagcaacccactgaccaagtgtcctgggctcttgtcctcaaaatggcaggttgtggttgttggtgacaatgaggcgtgaaggggaagcctttactccaaagcaaggggaacctgattagaatcagttggaagcccaccaccactactgtcataaaagatttgggagagacatcatcaagatggctgagtaggggtgcccaacattcaccctttccacaaagaaggacgaaaagaacaagtagataatcacatatggaatacagcatctaggggagaacaatggaattcaacaaggaaatgacaaagaccctctgaggcatggaaacttgggatggcagcatagagaggaaagtgaagcacctggctagcatctgctctgagccaagagggactccccattgcagggaaaaagtaagtgggagatctccagtagtccacattccctccacatacacctgcaatcccagctttaggagagccccacaatcctcacaggccctgagcccagtgtaggggctgcctggagtccatgcggctgcattactccagaaagggaattcacactggggcccctccccaccccactccccaggacccaggctgctgtaagcacaatgccattttgaggatggagtcactgctggagtgcttggggtcccaatagctcctgcatcttcacatccctggagccacaatgtcatcctaacacactcacacaaagaaattgaaaaggacacaaaaaatggaaatacactccatgttcatggattggaagaatgaatatcgtcaaaacaatcatactgcccaaaatgatctacagattcaatgtaatctctatcaaaatactgaggtcgtttttcacagaaatagaaaaaacatcttaaaatttgtatagaaccacaaaagaccctgattacccaaagcaaccctgagcaaaaagaagaaagctggaggcatcacactgcctgacttcaaaatatactacaaagctatagtaaccaaaacatcatggtataaaaacagatatagacccatggaacagtatagagagtccagaaataaatcccccatatacagccaactgattttcaataaaggcaccaagaacatatgttggggaaaggacagtctcttcaataagtagtgctgggaaaactggatattcatatacagaagaatgaaactaggaccctatctctaaccatatacaaaaatcaattcaaaatagactaaagacttaaatgtaagtcccaaaactataaaactactagaagaaaacataggggaaatgcttcaggacattggtctgggcaaagatttttatggctaagactttaaaagcacaggcagcaaaagcaaaaataggcaaataggattatatcaaactaaaaagtttctgtacagcaaagaaaacaacagagtgaagagacaactccttgaatgggagaaaatatttgcaagatattcatctgacaaggaattaatatccagaatatgcaaggagctaaaacaattcaacagtggaaaaacaaataatgcaattaaaaaatgggcaaatgatctgaatagatatttctcaaaagaagacatacaaatggccaagaagtatatgaaaaaatgctcagtatcactaatttttatggaaatgtaaatcaaaatcacaatgagatactatgtcaccccagttagaatggctactatcaaagacaaaaaataacaaataccagcaaagatgtagagaaaagagaactcatatactatcggtggggatgcgatgatgtgactgggttaggatagtggccaaggagatctggatcatggaaaggtcagggacttgtccaaatccaggctctaccttacctccctcttccctgcagattaggtgaaccccaggggatggctcagcccatcaaggccagaagcttcttaagggcctgtctatccatgctctatggctgagtggcaggttagccttacagcttgccatctagacttgacctggtgtcctttgtctggtttttggcctagtttcctctcccagtatgctgaatcctgctcaggatttctgctgcctcttaggactggagctctactttgtttgtatttgtcttcccagtttcttcactcccttccctggcatggcaccctatttagatcaaataaagaaatatatgtacagaaactgcaaattgtcccccaatagccactctccctttcttctgaaaccataaagctcctgatttttagttaggtattctgtgtcttagtccattttgttctgctatagcagaatactcaagactggataatttataataaatagaagtttatttggctcatggttttggaggctgggaagtccaagagtcatggtgtcagcaactggtgagggcctttgtgctgtcatcccatggtggaaactggaagggcagagtgtgagagtgaaagaatgggagggggccacattcacttctctaacaaacccacttttgtgatgactaactcattcccaagataatgacattaatccattattgatcacctcttatagttcccacctctccacattgttgcattggagattaagtttccaacaaatgaactttggaagacatattctaatagcattccatgacactaggtgtggccatataactaagttccggcctatgggatatgagtaaaaaagatgtatccttcttcccacttgcagggatgtgggcctagggaggagtcaccaaagagatgaagcctaggcccttgatgacttcattaagtggagccatcacaccaatttggacttttatgtgaatcagaaataaacatctgtcttgtttaggccactgtcctttggaccctgttttggatgcaactgaagtcatttcttccccaatagggttgtagtcatgttataatcttttctgaatgcctatatgtgttagacacttctacaagtttgagatcacaatgcactaaagtcctgaggtagactaatcaccccatatttatcgatgatgacttagtctcaagtgtcaatgaaaggatctgagatttcaccaaagtctgtgtgaccccaaatccgtgacctttctgcactaagcctcatagcaggtgatacaaattcaggtgtttttaattttattaaatatataacagtgagtagaagccaaatggaaatttggatttgcaaaaggaaatctgggctctaagaaggcaactagagcaatgtatgtcaagcttgaatgtgcaaatgaatcttctagggatgatccgttcctacccaaaaacacacgaggaaaagcaaagaatgtgaaagcccaatctctttagctcctggaattggcctgagcagccaatagctaataataaacccttgtgttctaatattagtataactttacagaatctcctgggatgaagttagtctgagtggatacgtgtcaagcaggggctctcaaattgtggtccctgaaccagcagcaacagcatcactgggaacttactgaaattgctgattatcaggctccaccccagacccactgaatcagaaactctagggttgaggtggaggggtcttgggatttctccaggggattctgatgtgtgctgaaatttaagaaacactggtgtggaagaaaaagcttgggaagaggcaattaacaacataatggaataaaagccttcagctggaaattggaaaatctacagtccagtcctagctgtctccttgttcataaaatggagatgagagcactgacttcactaagtaatttgcagaattaaacacaatgctgtttttgagaggcaacataacagtggttaagagcacagattctagagaacagtctggcttcaaatactggctctcagttattagatggacaaatcactcctttgttatctgttaaagtgaggggtaataacagcatacgtatctcgtatggttgcaagggtgaaatgagttaacaacgtttgtaaagcacttagaagagtgtcaggcaacaagtgccatataagtgtttgttaaattatatatctatgtgcctctatctatttatttatctatcatctatctatctatctatccatctatctatctaatctatctgtctatctatcatgcttggtacatgcagtgactattcagaaagtatcttttatttgagaaagaaaatggagcaaacagggatgaataagaagaggttgttaactgccagaggtctagagaacaccccccttcccacaggaacccctatccccactcccaaggggcctctcccagtgcaacctggaggtgtgtaagaattttctgtctgccatggtgtgattcagcatttggtggaaattgtctcctggaggaactggcatctctgcaaaaggtccattcagacttaagaatgtagaaacctggccagtgcagctgaaggtagctctgccatttctccaggggacttagtggattctggggacctcatgggggttaagatcacaagggactcccatcagaggagctggaggaatgaggggctggtgctgtataaaatgcagctctgttaaaatttctatttttttaaaaacaattgtattgaggcatattttacacacaaaaatcacccattttaagagcacaacttagtgatttaaaaaacatttaccaagttgtgcaaccatcattataatccagttttagaccatttccagcacccacagaagatctctcatgcctgtttacaatttaacctattttcccactcccagcctgaggcaatcaccaatctaccttctgtctctgtagatttgcctattctggacgtttaatagaaatggagtcatacaatatgtggtcttttggatctggcttctttcactcagcataatgttatttctgaaattcattcatgttctctagcatgtatcattttattccctcctattattgaatagctttctgttgttacagctgtaccacattttgtctatccattcaccagttggatatttgggttgtttccacatttttggctatcgtgaataatggtgctatgaacatttacatgcaaatctttgtgtggacatatgttttcatttctcttgggtagattcctaggagaggaattgctgggtcataaggtaaatttaggtttcaagtttaaataaactaatgaactgttttccatttcacattctcaccagtaacatatgagggttccagtttctccatattctcaccaacatttgtcattgtctttttttttttaaattatagccattttagtgggatgtgaaatactatctcattgtggtgtcaatatgcattttcctgatgactaatgatgttgagcatcttttgaaatgtgcttatttgccattcatgtatcttctttgctgaaatgtctacccaaatatataaaattttgggtttaatagtagatatcatgtggctaccaccttattctgcccttgggtactcaggcaggaggactatctccaaggtgagctggagtccctgagactggcggtagaccagggtttccaggaggctaacacactcctgcatcggccactttcaaccttttcacctgaggattaaggagcaattctataaactcctgaactagagaaaaggtgcattctttaaaatacatgcttgatttgttttttttctgtgaattatatttttccttttcctattttaaagaaagttaatcttctgtaaaaaacaatcacgaagctaaggttggatttatttagctgttattaagatacgtgtgtattttagaaaatggagatttctgttgtttttaaatttatgccattgttttcctttattttcatttgtgtgagtctgattaacaaatgatgccactaagaaggaccctaccactatcttggatgaggaatatagatggcatgtagtgagtaaaaataaatttctgactaccaagtagcagtagatcattagtgggatggcacatcgagctaatggcattagagataatggagaagggggtgaggaatgggagccaacatgtttcctagagcttcaaagtatggccctgataggctcggccggaaagcctgtattactgaaaagcccaaaccactccctagtgcttgtggagaatcaccacagagtttacctctgagctggaccctgaggtctgatggctagcccttccagaatggccagtggcatattctagcaatatttctgtgaaatctggccaactcaggcgtaggggagggaccattcttgtggtagggggagggatcatgattccaagagctactgctaccaggaggatgctactgctaccattgttgttattttttatgttgttgctgttgttttgttttcttcttcttcttttttgagacatagtctcactcggtcacccaggctggaatgcagtagtgcgatcacagctcactgcagccttgacctccctgggctcaggtgatcctcccccctcagcctcccaagtacctgagaccatgaggtttcaacaaggtttcaccatgttgcctaggctagtctcgaattcctgggctcaagtgatctgccagcctcagcctcccaaagtgctgggattataggcatgtgccactgggcccagccaccattgtttttttgtgttaaaactatcttcagtttaaccaatgatggccactggtcagcagaaagacacaggaaggatgacatagaaatagactgaggggtgctataggccagatttcctctttattccatccatcttgccctaaaggtggcaatggatatccttcaatggaacacaaaggactggaccccagccacaagggctatacacataacttggtttatttatttaaaaaataaacatggtaataataattatgtagtagaattgatgtgagataaaatgtatgcattgtgccagaagaaagtaggcactcagtaaacaggctgttattatgctgtgctgacatgtgttgagtgtttaacttgtaagccacaaagagcacatagttgcagattttccatcctattgattaattcgttgattgaggcatttcctcaacccacatttaaaaatgtctactttgtagcaacaatatttctgggtgcagagaatgcaaagatgcacgaaacagtgtctctatcctcaagttgttaaaaattagttgggaagttaattctagaagactgtgtcaatgactctgacagacggttgaaaaaagtaccattgggggacagaaaaggaagtgattcattgtacctggggacaaggagggagcaagagtcatggaagatagtccaaaaaatgtgatatttgagctgggctttgaaggatagataggagttcactaggtagcgatggcagggagaatatttttagtagatgaaataggaaatagcatggacctagtcacaagagtatgtatttggagaactttaaatatccaactattatagagtgggcataggtttgggtggtagcagggttgggagggtatgaactggaaatatatttcggggtgagatttcacaaggccctaaatggcattttaaggactttaagctaaacactgcaggtaaaaagaaaacagaatggcttaggagtggcataactattttcccaaattcataatttttttttcaacttgctgggcacaagtcagctactaaacatatcccagttgtccaatctctttaggaaaaaatgacttatagaaggagaaatccaaaatttaataggaaacatggtagatcacctgacctctggccaatgataaaaacaaaatcccattacaataaacaccattataaagactgcttactacaaagctatttctaggcagatggctcagaaacaccatactctttttatctagtcaaaataacttatgtacgatggataacccagtgcaataaattctttgttccctgtgcttataacgatctctttctatagggaaggtaactgctgttataccacaggcaggaagaggaggctgagttgaactgtagctgaactccatttaatttttctctgtagctatcaatccccaactattccttgactccctttaccatctcctccacaaaaattccaatcccttcatccagaaaagctcattgagactcccaatccacccacctaacttctcaaacaaaacactttaaccccgaatatctggagctcaaaaaaggaaaccctattgctcgacaaatatggtggattctgggcatctgaagattcaacaactaccattccaactctttgtgagtgaccctgacagtcatttctatttttggtggggcatgaatttcaggcaccacagcaagcctcttactaagggaagtccagccgactgctagcatttttttctcaaggtggctttgttttctttgcttgtcacatacatgttcttgctcaggaagttatattttgctgcatttgatgaaggatgctatgttccagggaaattaaccaatttggaaattcaagaaggtctgatggttaaataccttaggaatgttaaagacctattctgcttcttaacacttgccaatagtgagtaggcatatggtccttatcagtgtgtgtattagtccattttcatactgctatgaagaaatacccaagactgggtaatttataaagaaaaagaggtttaatagattcacagttccacatagctggggaagcctcacaatcatggcagaaggtgaaggaagagcaaaggcacgtcttacatggcggcagtgtgtccggaattggtgggttcttggtctcactgacttcaagaatgaagccgcggaccctcgtggtgagtgttacagctcttaaggtggcgcgtctggagtctgccccttctgatgttcagatgtgtttggagtttcttccttctggtgggttcgtggtctcgctggctcaggagtgaagctgcagaccttcgcggtgagtgttacagctcttaaggcagtgcgtctggagttgttcgttcctcccggtgggctcgtggtctcgttgggctcaggagtgaagctgcagatcttcgccgtgagtgttacaactcataaaagcagcgtggacccaaagagtgagcagtagcaagatttattgcaaagagcgaaacaacaaagcttccacagtgtggaaggggacccaagtgggttgccaatgctggctcgggcagcctgcttttattctcttatctggccccacccacatcctgctgattggtagagccgagtggcctgttttgtcatggcgctgattggtgcatttacaatcccagagctagatacaaaggttctccatgtccccaacagattagttagatacagagtttcgacacacaggttctccaaggcccaccagagcagctagatacagagtgtcgaccggtgcactcacaaaccttgagctaaaccagggtgctgattggtgtgtttacaaaccttgagctagatacagagtgctgattggtgtatttacaatccttgagctagaggtaaagactctccacgtcctcaccagagcagctagatacagagtgtcgattggtgcactcacaaaccttgagctaaacacagggtgctgattggtgtatttacaatccctgagctagatataaagactctccacgtccccaccagactcaggagcccagctggcttcacctagtggatcccacactggggctgcaggtggagctgcctgccagtcctgcgctgtgtgctcgcattcctcagcccttgggtggtcgatgggactgagcgccgtggagcagggggtggtgctcgtcagggaggctcgggccgcacaggagcccatggaggcggtgggaggctcaggcatggcgggctgcaggtcccgagccctgccccgtgggaaggcagctaaggcccggcgagaaatcgagcacagcgccggtgggccagcactgctgggggactcagtacaccctccgcagccactggcccgggtgctaagtcccccattgcccggggccagcagggctggctggctgctccgagtgcggtgcccgccaagcccacgcccacccggaactccagctggcccgcaagcgccgcacgcagccccggttcccgctcgtgcctctccctccacacctccctgcaagctgagggagtgggttccggccttggccagcccagaaaggggctcccacagtgcagtggggggctgaagggctcctcaaatgccaccaaagtgggagcccaggcaggggagttgcccagagcaagcgagggctctgaggactgccatcacactgtcacctctcagcaggaaagttcgtgtgcaggggaactgccctttacaaaaccataagatctcatgagacgtattcactaacacaagaacagcacgggaaaaactcacccccatgattcaattacctcccaccaggtccctcccacaacacgtgggggttatgggagctaaaatgtaagatgagatttgggtggggtcagtgtgtgtttttttaatccttatttttgaaaataaaatttcaaactcatagaaaaatggcaggaacagtatcatgaacttccataagctttcacctagatgtacctattaacatttttcagaagataagacaattatgagtcaaagtaataagtgagacagggtattggttagtctaacagactcctgaatctcactctatgtgtatgcacattgttgtgtattattattattattatttacagaaccatttgaggttaacttgcagacatcatgactttttacctctaaatatttcagtatgtaatggcatacttttacaaacccacagtgcaattatccaattctggaaattgagcattgatacactaccattaactagtagcacatccatattgaaattttgctgattgtttcaatactatcctttagagcaatgaaaaaactatccatgtcccaacctaggataaagcattgcattcagttgtaatgtttttagtcctctttactctggaacagctcctcggtctgtctttgtttttcatgacattgatttatcttgaagagtatagtctcattatttcatagaatgttccttgttttgggtttgtctaatacttccttaagattggattcaggttatgcattgtgggccggaactttacttggattttaatttttattcttgttaattaagaatgtggctttcaaatagtatagtcattattaaaaaattctcctgcagctaaatatcaagcatgggttccaaggagacccatgttagtggaatttttcccccacccccttgggaacacagattatgaaaatcacttcaaagggagctaatttggagaagtcaacaaaacaaacagtcctcctggtgggttggttccttcccatgttgccagtctgtccatggagagcctttgtgctccagtattttccttttgcctcaccacactgctgtccctcagtaaagcatctgaaagtcagcaatggaaggagtgtgaagacttggaatgacatttaccagcagaaagctggaggtggctcacgttactaaatctttattacttttgcaaaacacatcacaaaatataataaatagttcacattaagctgcacctatcaaaacatgtcaagttcactttgtgatatagcatcgttgacttggattgttgctaattctcaattattcattaaatggacatggatgctaccctctccctaacattagtgagaattcaagcactttcagtgattcaaatgtgaagtgctaagcctcagaaaatgagatgtggagacaaaataagcttaaatatgtatctcttcctttcttctttcatccagcaaaatgctattgagaaactactttatatcaggcgctgtgctaagtacgggggtttcggggattaaaggcctagtccttgacctcaaggagcatttattagaacctgagatttggacccaaaagccagagccaacattttcttcttgcttaatggcatcacttcacattttgtcctagtttaggtggtgataaggcagaatccacttggtaatgttgtgactcctgcttcagaccgttggctcaaagtggctgtcatcatatataggtgtgtccctgagcctccccaagagctaagaagtactttttccacaatagtacatgccattatggtgtcttcaacctgctatcaaccttttaagcctgcattcttacaactttcaatggttttcaatccctttccatattaaggtctgtaaggggtcatgggctttgattgtgccatgtacatctgttaattcattaaaaatccgttgcagtgtgaacatagtataatagaaatcacggtggacttggattcgggtgatgtgggtgagattggctaatattccccactcctgtgttctattcttgggcacacagctagacaccattttccaggctctcttgtggctaggtgtggccatgtcactgagttctggccaacagaatctaagcacaaatatctatcgcttctaggcctgcctcacagaaacctgccacatgtgtcctgccacttttgcttcatgcagacaaaccacgtgttaatgatggagccacaagatgccatgtacctgtctttgtgagtcaccatgtggacccccaatttccccccaatgaatagggacccacgtattggattattccagaaccaagaaataaatgtctcctatgtgttaagtcactgagattttgatgtctgttacagtagtcataaatactctgtcccatcaataactttgacttttgtcttacctgctatttacccttgggcaagtcacttaacctctcatcttctctataaccttctctgtcaatgggggtaataagataagcattcttggccccattttacagatgaaaggattaaatgcggtaacatttgcaaaaatactttgtaaacgattacacaaatagaaggtggtggtattattattggatcttgtccctcacagtagctaatagaacattttccattgaggaatctcaattccttttcaaaccagcaatattttctgctaaatgtgtagctggagctggtcctggatcacctgaatttctcaggccatataaattggggcgaggaatactcagactttgccaaatccctctgacatgtcagtttcaggactatgcccacctagtccaggccactgactgctccttacagtctcaggtgatgtcccagatgtctcagaacttgatatactgaccaactaattcctatggtcatctagggccccaccataggtgtcaaaacgatgagttttccaagcctttcctgttttcccaaaagtcacatgataataacaaatgtaatattgagtgcccactatgtgccaaattgcatgcattatcccaggtcatcttcacaaccactgcaggaaggaagtgcctattagtcccattttgcagatgataaaactgaggtgtatgaaatttgctcaaagtcaattagagtagatggattaatatttatgtttctaaaagatctatgctcttaacctctgtgtgtccaattgttaactctgcctcacagcccagcattgcccattcccttctaagagtctcactgctgagaaagccaaatctcattataggagaaaaggatgttactttttaaaggacccagcagcaaacatctctttgcatgcttcaaatggacattaataatggacatcattcctgctcatttttctccaaatttattatttatttatctaattcaatgcaccttaatttgcctgcaagtcatattaatgtgattgtttaaaatgataaggaccctctgagggaaagtgaacatcaacagtgtaacatcaatattcagtgtctgagagcaagtacaggggcgagtggtgtttctacttcaataggtgcctgtctctttgttgggtcacagaccttaatccaccccaaagtgcttgtcaacatagtgcacgaaggagatgcctgggaagtttcctgctctaccagttgtaattacatgaaaaataaatggaaaaattgggttattttgctcgctacctgacagggacttaacatcccagattgtatggccaatatgtgttgaaccaatatcccatggatctttctatactgactcccagcttttgacctatctcctgtggaagttgaggaatttggctaccaaacaagtatgttatgtgttattaaggacaggcaatatgtgacaatttgtacttacggaatgtataaagtcaggagttaagtaggtcttggttagttgaactcttgaaatttcaaaaagttcaagtctccctgaaatttggaggggctgagtcttatctgaatgactttgttatcatcaaatgattcaattcatgaaggaggggacccttcttatggcacaatatctgaatttatcattgaagttaacaggaaggcagtatttgatcagccaatacttcatgtacgtcccctctaatcttccaacccctctgcagcctaggccttcttagctccatcctatagatcaagaagttacagtaagcagacctaattacgttaaagtgtcagacccagggtttgaagtcaaatggtcttggtcccatagcccaaacccaaatatttttctgtttggaacatgtctgtttcctaaatagaagttcttataatctaaaaatccacaagaagttgttgtgaaggaatttcaaggaaagaaacagaaggcttgctttgtcagagctcttctggtcagctatggtgagcctgctctcttcattgtgcattctccacaaaagaacctctgctgacgccagaggtctctcccctaggagtgaaaggggaccaagcaggggagatcttggtgaatattggaaagatggagccaaggagacccatgcacttccaattagacagcatgctttccatggctcgctcaacgccttgctccttctcaaagcatgctcagagagtttcagctttggcaaaggcttgagagatttcatgctcctttccccccaagtaataaaaaagtcatttttgcctcaagctagggaaaacactggcagaattaaactttaaaatctttgggtgagctttttttttttttaaattaaatttattgttgctgttgtttggaaaccttgtggacattcaccacttttagttccctggctaagcttttctggaaacttctgtggaaaggagggttaaaagcagaggaattaggttggtttttaaactccaagtctgatgatgagtgggtagaggattttaaaaactgcacctgctgggtttcaaatggcatacaacccagtcatagttctggagagagagcagaggactggcaagaatgccattcccagtggggtatggcttcctgtttgggttcctcactttccaaaagcatggaacaaagcaagtgaaaaagcttgctctcaaccctttggaaaagccagagtaagacgcatttatttaaggtgtacatcttgatgatttgatagatgtgtacattgtgaaataatcaccataatcaagctaattaacgtatatacaataaaaatcctaaaataagatgtcaccattctgtgttcactgagcagcctggggaggcttgcccatgtgcacatcttcctttgctcattaatttcccctaaaaagaaagcaggaaataaagatccaacccttcataatccaaaccacacggggaagaggcaaagcagagccttcaccaagaattcagacgttcagtgtggtggtcagacctcactgtacagactccaaattccaaatgagctttgcctaattcctccagttctctctcaccatcttggacctgcacaaaaacgtatctcttttggcttttttgcagaccacacaattgcattgcacaacctcagcctctgacattatcccctttatgctttaaaggccagggaactgaccctaaagtttacatgggccagataagtgacttccagctaagggtaggtcactatatccttagtttccaaaaaaagtctctccacacattctcctttgatttacgggtagactagaaatgaaataattaccttaaatcttactttacatgtcacaatatgaagatttatcccagacacaagcatacattcttaattatcattctttaaaatctccccctaccccatccctcctagagccaccccctctcaccccagtttaactggacacctccagtttcttcctccttctctcatttttggagggtagaaaacactccattttcctttttcatttttgtgacttgaatatctcagaagatattcaagatatgggagagagacatgcacccctcccaccccatttcctagtcatgtttccagatattagaggcttctttggtagaggagtacctgtcccatctcccaaatctttcagccttggaacccaagtgcagggagtgaaacattcagttggtcaacaaatatctgtggagtacccaccaggtgctagctagaccctggagatgcagtgagaaaagacatagtcctgctccttcagggactcttcaggtaaggagcagaaattctaccttctaggtttcttctgtcaacccccattctttttttttttttttttttttttttttgaaatggagtctcgctctgtcgcccaggctggagcgcagtggcgcaatctcggctcactgcaagctctgtctctcaggttcacgccgttctcctgcctcagcctcccaagcagctgggactacagttgcccaccaccacgcccagctaattttttgtatttttagtagagacgggatttcaccatgttagccaggatggtctcgatctcctaacctcgtgatccgcccgcctcagcctcccaaagtgctgggattacaggcgtgacccactgcgcccggccttgtcaacccccattctaatctcagccccaggggcaacaaatgtaagcaatgccagaaccttcgattctaacatcaactccctaccggccacgacggtcatttctgccagtctcacaatgcttccaggactctccacctaattgcacactcacatttgggggtgctcatgaacacaattcctagtgtcaggcacctaagcactttttaaacctctttcttaaacatgcaatttaataggtacattttggccacaccagttctacatttttggcagtcctccacaagtttacatgccccagataagtgacttctggctaagggcaggtcactatatccttagtttccaaaaataaataaataaataaataaataaataaataaataaataaataaataaaaagtctctccacacattcttctttgatttaggggtagactagaaagaaaataattaccttaaatcttattttacatgtcacaatatgaagatttatcccagacacaagcatacattcttaattataatcacagcattgatctgagcaagtataagatatatggccacaagttgctggtggttttgtattaccattttagtgcaattaacgtctaccactaaagcaccatcttacgcataagacaaaattaaaaagaagcttgaaatgttatatcctatccaggaaatgttactactgcattttcaagatgaggagttaaggttttcatttttaattactttactgagtgattcttcttaagggaacctaattgtgaagaatataaattactttgcaagtttatggtgggggactagtaatccttttgggatgcaaacagaaaagcaaacgagaatttaggaacactcaatggtaaaatttaacatttctgtccggttgtaactcttttgaaaaaatcccttatagaagaatattgtcattaataatttcatcattcatgaagcattgactataatgctcagcatttttgctgcaatttatgcggggtataaaggaagacagcttgtatggtttcaaggctttagctcttccctgtctaggtcttccttcttctgcagaatgtctgtctcctcttgtctaacaggtgcccaatcttccaagagtgctccttggagcaacactgtgcagtgccccaggtttgcaaattcactcttcctttgctacaattagaatcacatttctttccctccaagctactcagctagctgttagggtaaagcagctgattaaacaaagtcacactcgtgttgatgactaaaagcacttaacgctccctggggtgtctgcatctgagactgagcctttaatggtgaaatttcaggcattgcgacaggctagtggggctatactttttggtgtctgttggggggcatatgttttgatgccactcaaatcataccacttgtagatgttagaagctggtagaaaaagattttgtaaaattacattttgcctaagacctttcttctagggctttaaatgataggtcttagaactctcttagtcctgagaaagttttgttcaggatcaacccatctgccccttctctgaatagtgtgactctcaaccacagatgctgccttgtagagctgcagaaatatcccttgtgcaaattcattcccaataaatggaatcctaactttggtagaaatagagcaaatccttaacattggccaaggagggagccccagacctttcattttccccataaaagagggtaaagtatagctttccagggtgcatgcatgtgaggataacaacagacatttactatatttccagcacaattccatgtgctttccataatacacaaaatgaactcacaagactaaagaagtgcaaaataaattcgaataatttaacttctgaatgatggtttttgtaagtttgtagcatttatacttctgaagttattaaagcttaaaaaaagcactaacacttttgggtcatcctgtatttactcatttaaccttcatgacaactctcaagtgtaggtaccattatttatcccatttaaaggatgggaaaacaaaggcgctgtgagggtaagtaacccactcattgttatgtagcagcaagagacacagctgggattataaagccaggaagtgtaattccagtgttcatgctcttagccactccgccacactgcctcttggcatcagtaagagacagcagagatgctgctgtacctgaaggccagctagactcagttactagacaaatgcgtcactctccacaccagcctcaaattgccatgattcaatttcagccctcacatcatggctcctttccacattttgtggattgtgaggccatgattaggataaaaatatgaataataaatctagggctgctaagggtacaccatgtctcccactttaatatcccctgcactttttcatagcataatcccatcacacctgttgaattaaattaaatggaattgccaggaccctttggcattctatgggcagtttgggcaggccctcctgtcttgccctccacataatttcagacctgttggatggccttggcatggccccagtttctcccctccattctccttgcccatctcatggaaccttctttcataagcccaccacctgccccagcccaaagagccatagtgagggcctcctactgtctacataatagcccccaagtctgctgacttctttaatggcaaggaaagcacagtgctccgttttgggaagccagtcctgactaggccagaactggacctgaaactgttctatatctgcagtcaggcagtcaatcagcttcctctggctcaatccagggacttcatttgcccttttcagaccacctgtgtctcatttcccagactcgctggcccccatttgcccttgactggggggctctggtctccttaccctgttttcttggcattcccagccctcgtgaccctggtgagtgaaaggtattaacacctaagaaccagagggctctgtctgtctttcacggcccacaaacagaaggcttacttgttgacctaactttatggcactgtccctggcacctggagccccctgagactaacctggtcccattagccaaggctctatcaacagtactttatttcttgtaggcatttctgaaaactgagaggttgcttggggatttctgagccttgagttgattagcagttaatgatgtgtgttttgatgagaacataaaagattttgtttattcactcgagaggaggaaagttaggagtaaaaaggagagaaggaaaaacacaaattctcagtttttcaatggggttttaagtggtttagatctgcggagttcccagccaatgctgggcaattctctgggtgttgattttaatatcagctctcagaacaattcatagagagttcgtctccacctagagctgtcaggaggcatacagaaggcccagaaaggctgctggacaatccattttactattcagagaatgcgtgaatacagccaggagatgcatttgtacttccacatgaaggagagggagagaggagcccacagcagatagaggtaacttctaacagtgcgtcctccaactggagccatggttctagaagccatgtctagaaagacacccccaacagggtcagcatgtacagaaaggacgtttgtcaaacttgctcccagtctactgctgttgaagtcgtgggcaaagtggaaggggctccagaaaggcagaatgtggcaatcgaaaaggaataagctttggagttaaaccaacctgtgctggaaactggtttattccaggtttctctacctatcttgatctcagttttcatttctgaaatgaactggtagtactggatttaacttgtagagttgctgtgaagattcaacatttccatgtgtgaaattaactggcacagatcaggtgccagtgattgtgatttaccctcccctacccctttccctttttcctctacaaagtctgcactctccattccccagtgtgcctacggtcttcaactgctgactttcaaaacaaatgaactgaggtggtcaacaccttctggggattcaagttctttcaaaaacaactcacaagggaaatagtaattcacaatgcttcccttcgggcatataaagtactgatgttggagtttgacaaacggtttgggacaataaactcacttggttggtggtaggcagtcaaagccttgctttccgaatcggcctgcagaaacaatgttctttgctgttagttagtcctactcaggccagtccagccagtcacatctcaagtgagcactgatagttacaagtggggctagctgagaggctgggtgagggcctttccctatcactattcctaaggcaacttggggcacatcttaaaggccagcagcattatctttactttgcaagaagagtacatattgtaggaggtgcccttgggtgagcatccgctctgaaatgtttactgctgttcactggaagtcctacgtctgaaggtgaatgagagtatctcagctattctagaacagtctcctgtcgctgaactacctttgcctctggggttggaggagtgaaatttgtgacttggatcatctaggaaggagttttggaaggggcagctctgcatgtgaggttgcacagtataggatacagccaccacccagaatagtccccaaaatcagaaacatattcaatgacaggtgaaaagaggaagaccttggtctaagtagactccagtctaattcttctatatttctgcctctaggaacacaacaaaattgtgttctctccatttgaagagaatttttcaatcaaaggcaggggcttgtcagaacttcgttttcattctggcagtgatttaattctataagtttattttaacaaaggaatttgtttcccaattaagaaatagtttgcagggacatctctggggctgaggttcctttagtatgcctggaaaaagccaagagccattcaaggcagctagttatttcttcttcatgggataggtgatagtgagttcatcaatgacattggtgaattctttaaaaaaatgaaaaaaaggtacttggaactgctctaagtcctagaaggataacagaaaagactattcaggttttctcacatgggggtggcggtgataatggaggtgaggatggttgtcacctgcaaaccaaaggacataagccaattgggaagttatttggggtgtggataaggtcaaagtcatatgggaaaatttaatgggttattttatttcttgtttggagagaaatgaacgagtatattttctccagtaaaagctaagcctctccatgttttctaaaggtttagaggcttcttcttcaaccaatcccaagccaggaaatagaacaacacaaattcctgctgtcttaaggcctggtgcttgcatttgttcagtgagagaattgcctcctgtatacaactgtttaattgatattcccagagtgtgttcgaccttccagagtcttctttctaaaggctctttggacaactactggtggggttctttaaaagctgcctgcaaggcacagtctactgatgggggcgaaagttagtgggtgaatatttgaggagaagcaggttatcaccctcaaggtattttttaattacaaaggaaagaacagtaactttactgtggaacagctctgcagatacacctgaaccaagttaacatcattaataatcaggcatttccattacataacgctaaagggatcaattcaacaagaagagctaactatcctaagtatatatgcacccaatacaggagcacccagattcataaagcaagtccttagagatctacgaagagacttagactcccacacaataataatgggagactttaacaccccactgtcaacattagacagatcaacgagacagaaagttaacaaggatatccaggaattgaactcagctctgcaccaagtggacctaatagacatctacagacctctccaccccaaatcaacagaatatacattcctctcagcaccacatcgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtaaataatgaaatgaaggcagaaataaagatgttctttgaaaccaacgagaacaaagacacaacataccagaatctctgggacacattcaaagcagtgtgtacagggaaatttacagcactaaatgaccacaagagaaaggaggagagatctaaaattgacaccctaacatcacaattaaaagaactagagaagcaagagcaaacacattcaaaagctagcagaaggcaagaaataactaagatcggagaagaactgaaggagatagagacacaaaaaacccttcaaaaaatcaatgaatccaggagctggttttttgaaaagatcaacaaaattgatagaccgctagcaagactaataaagaagaaaagagagaagaatcgaatagacgcaataaaaaatgataaagggaatatcaccactgatcccatggaaatacaaactaccatcagagaatactataaacacctctacacaaataaactagaaaatctagaagaaatggataaattcctcgacacatacactctccaaagactaaaccaggaagaagttgaatccctcaatagaccaataacaggctctgaaattgaggcaataattaatagcctaccaaccaaaaaaagtccaggaccagatggattcacagctgaattcaaccagagatacaaggaggagctggtaccattccttttgaaactattccaatcaatagaaaaagagggaatcctccctaactcattttatgaggccagcatcatcctgatgccaaagccgggcagagacacaacaaaaaaagagaattttagaccaatatccctgatgaacatcgatgcaaaaatcctcaataaaatactggcaaaccgaatccagcagcacatcaaaaagtttatccaccatgatcaagtgggcttcatccctgggatgcaaggctggttcaacatatgcaaatcaataaatgtaatccagcatataaacagaaccaaagacaaaaaccacatgattatctcaatagatgcagaaaagacctttgacaaaattcaacagcccttcatgctaaaaactctcaataaattaggtattgatggggcgtatctcaaaataataagagctatctatgacaaacccacagccaatatcatactgaatgggcaaaaactggaagcattccctttgaaaactggcacaagacagggatgccctctctcaccactcctagtcaagatagtgttggaagttctggccagggcaatcaggcaggagaaagaaataaagggcattgaattaggaaaagaggaagtcaaattgtccctgtttgcagatgacatgatcatatacttagaaaaccccatcgtctcagcccaaaatctccttaagctgataagcaacttcagcaaagtctcaggatacaaaatcaatgtgcaaaaatcagaagcattcttatacaacaataacagacaaacagagagccaaatcatgagtgaaatcccattcacaattgcttcaaagagaataaaatacctaggaatccaacctacaagggatgtgaaagacctcttcaaggagaactacaaaccactgctcaatgaaataaaagaggatacaaacaaatggaagaacattccatgctcataggcaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaagacaatcctatgccaaaagaacaaagctggaggcatcacgctacctgacttcaaactatactacaaggctacagtaaccaaaacagcatggtactggtaccaaaacagagatatagaccaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacacaaattaattcaagatggattaaagacttaaatgttagacctaaaaccataaaaaccctagaagaaaacctaggcaataccattcaggacataggcatgggcaagggcttcatgtctaaaacaccaaaagctatggcaacaaaagccaaaattgacaaatgggatctaattaaactaaagagcttctgcacagcaaaagaaactaccatcagagtgaacaggcaacctacagaatgggagaaaatttttgcaagctactcatctgacaaagggctaatatccagaatctacaaagaactccaacaaatttacaagaaaaaaacaaacaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttttagaatggcgatcattaaaaagtcaggaaacaacaggtgctggtgaggatgtggaaaaataggaacacttttaccctgttggtgggactgtaaactagttcaaccattgtggaagacagtgtggcgattcctcaaggatctagaactagaaataccatttgactcagccatcccattactgggtatatacccaaaggactataaatcatgctgctataaagacacatgcacacatatgtttgctgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaagaacaaaaaaccaaacactgcatattctcactcataggtgggaattgaacgatgagaacacttggacacaggaaggggaatgccacacaggggggcctgttgtggggtggggggaggggggagggaaagcattagcagatatacccaatgtaaatgacgagttaatgggtgcagcacacaaacatggcacatgtatacatatgtaacaaacctgcacattgtgcacatgtaccctagaacttagcccatagttaaaaaaaaaaagaaaaaaaataatcaggcatgtcatcctcatggatattctgatatgatgccctgagaagggcatagtattgcctctatggtattctcgccaaacatccataacctcgatctaatatgagaaaataccagacaaacccaaattgaggaacattctgcaagataactaaccagtgcttttcgaaagtctcaaggtcagaaaagccaagggaagatagaggagctgtcacagattgaaggtgcctaaggaggagtagatcttggaaattagcagaaaaactgttaaaatccaaataagttccgtagttcagttggtagtactgaactaattttaattttctggttttgataatgatttaatgcttatacaagatgttaatgttaggcaaagctgggtgaaaggtattcacaaattctctacaatttttacaacttttctgtaagtctaaacttattccaaaatacaaagttaaaaaaaagcttcctgaaaacaaaacaaaacaaaaaataaccactagctagcataatattgccctaccaagtgcctcagtggctcggtgaacgagatgagggtacataattatcttcttccacattctgtgtttaattcctacaagttgtaacttgtgcagctcatctcagtcccgtgggcagcctaagaaaatgatatttcatgtttcaagactaaaagggtaaaattgagaagagcccctccaccttggtttcacaagctttattacttgtaagcaatgtgtctgtgagcagggacataccaatgatgtaaaaagacacattttttaaaggctgaaacatggaatagagaatttaaggcaggaggattgcccattatttgatcttttttgttcttaaaagctgcgtacttcttttgagtcagaatccagttgtttcaagtcctcattaatcagtgacaccattcatcaaatggacacattggcataatgagctctcataaatacactgtttgtgatctttcttggaatattagagtgaggaatggggggtggaaagactaaaatcacgcagtaccccatctacttagtttaaatcatacttacatatgccacactgaattaacatcctgtcatattttctgtttcatctctctctctctctctcaactctacttctttgtctcacttcgtctctctttctctctcttgcatataatagaataaaccaagggcacctccccccagtcccttaattgaggcagttcaggtcaaatcatgattgttaacgaaaagaaaccaaatcatttgtcacagagcttaattttgcttgcgctgcctgatttcctgctgttatttgtacttagagtagatgataaaagcagttgctacagcctcttcacaggaaaacaaatcccagctgcaatccgagtcaaaacacctggggctggcggatcagctgggatggaacagctattttttccaagctttggttcacccttcaggttgattgaaatgaacggagccgtttttgaatgaaagttaactcccacatttcctaagtacctttgctctcaaatgagtgagtgtttggggttactcctgagaaaatgtggaggccccacagccctttcctccttatatcacctcagaactcacagacttcccctaggtttctggatgggtgcaaaagtaattgcggtgttttttgtttgtttgtttgttttgccattacttttaatggaaaaaactgcaattacttttgcaacaacctaataaaactgcaattcatgggcttggatccccctgcccccaccaagtatgaagatggaaattgactgtgtacacattggaaggtgaagagtcatcaccgagaagcgaggagagcagagtcttcttgtggggaaaagacatgacattttattgttcatttgtggaaatgacaattccttggaatcccataatttcaacgctttctcctccaattttcaccttgctaacggtctattgattacagaggtggggccagttttgagagctgtcttacagatggagaaacaggtatgttaggcatgtctttggtcatatggaggttcagaaataacttgatagctgctggttgtgatcagccttctggtgtgatctcccatccccaaaaccaccatacaggactttcctggggcctctcgaatgcccgccaatgagatagtggtcttcttttcctggaatccagccctagccatggctcaatccaggttgtggtgtgtgagtgtggtgtgtgtgtcctgtgtttatgggcaggatattattctgcatcagggaggacatacagcctaagaggagagattttgggataccaggtattgctctgcgatgactcaattttactttctgaaataattgcctttgaggacttctgctctatgacagaggtttccaagtctgcctgaacatctgagtcagatggaaaagcttttaaaatgcagattttagggctctaacctaatcttatggaatcagaacttctaagggaagggccaaggaaaaagtctttcccaaaaaacctagcagatggctcagaccaaaatccaggtttgggaaccacacattgaccgctattaaccaatcattatttcctgattttatgggatacagagtaataagaagaaaaatgtttatcattgactatgtgcacagtgctaagaggtttacttacataatcttatttaaccctcacaatagccctatgggaaaggtactgttattatccccactttaaagatgagaaaatggaagcttagagagataatgtaacttgcctaagatatttacatctagtaaggggggaatcaggattcatccacaaatggtctgatttctgagtctaggttcttatttactgggccataatgctttgggacgctgggtatcctcttagataattttgacctcagggcatgaagagtggaggagggaagtaactgtatcaaaaaagaatgaggcacagtgtgtcggggtgtgcctgtgcatgcttgcacacataagtgttagcaatgtggggagcagatggagaaatgaagaaactggtagatgactgagcctgagggaagaacagtacaatgggatagtgaaacaagaatgaatttagcagccaaagacttaagtgtgaaccccaggtctgccatttggtagctgtgtgactttaggcagggcatttaacatctctgtgccttggtttccctgtctccataaacaaaaccatgatacatatattgaaggtttgtagattatagagaaggtttataaaccatgctgtatggagtagatcctcagttatggcaacaattctcaaaggctgatgttctgagcccaaattgaaggttgtgataaaaaataatggaactgaagaaataattcaaagtggccagaaaaagctcagaacaaaattccctttaaaaaactgcctgggagccattgcatctttagatatggaagaaaagtgattcaaagcacagttgttctctggcccatatgaagaattgtaggaaaactggctggggtggtgtgtggtgggggggtggttgataaagatctgaagagtggctatagatgttttcaagttccaagacagtcattaaggatcagttgattttctcctctcttagcatcctgttctcaaaggtggccttgtgttctcaataagacaatgctggatctaacctgggaataccagggaagagaatacatggtccctggagttttgctgatgggtttggacctgaatttccaaatgatggcagaagatgggaagacatttagaagttgttctacaaacgtaaaaagaaaagcactacagccaaaggatgactaaaagggaacaatagtcctccatcattggaagaatataatggtcccagggagagtaattagataacctaaaaaggattcttgggaaagaaaactcagactctcaggaacattttctacatgtcaggacttgtgaaatagtgtttcaagagaagagacagaaactgtcttcactgaatcatggaaagtcaagtgaaaatttagcatgataaaacactccagctgggcatttccaatctagttcttgaagacacattcacaagacttagagttaagacagattttgagctatggccataagaatgaataaactattactgcatggaaaacatggataaatctcatgagcataatgttaagtgaaaaagctggacacaaagatgcatattatgtgattgcattaatagagagatccaaaggcggtaaaattaatctacgtgttacaagtcaggcattataattatctttggggtgtagtagttgagaggaaacacaaggaagattttaggggtgcttgtcatgttctgctttttcatctgagtgctagttatgtgcgtgtgttcagtttgtaaatgtccattgaattgtacactcatgacatgcatttttctgcacatttgttttaactcaataaagagttagaaaaacaaaagttttaatctgtgagcagagagcaatttatttcaagagaaaccaactccaaatatccaaccatagagtttccttctaattgcttcacccacccatgagaattttatcttttcttgagctgcaaattcttcaacttcaatatgtcaggctggatcttctgagaagtgtgtactaggataggattagatgtacaagggattcatcaggagaaattcctttgaaggataaagggagatgggacagtgggaatatactttaggccaaaatgccggtctgacacccttcaaaggagagagggaaagatggaggattgggtaggaagaccttcagaccgcagcacaatcctgagaaaatctcaggcaggttgatgggaggtccttgggcaagtattgcccagtagaggaatcctccactgggctaaaatagcgctattacagtatccctgccatgctctgtctaagctgctagcagcccaggggaagcatggcctttgtttgaatactgtggcgaattcaaaggtgcagcagttcaaggctgtcagtgaaacacatttctaggatgaggtcttcttgaagagagatctgggcagtggacatctatgcccaccacacctaggtatgcagtgatgctcatgagatgggaggtggctacagattgctccatatagaaatgttacctagcatgttaaagatattgagattaaagcattccagcttgtttccttgccatttaacagtgaggaaagagggagaaacaaaatgcagcaaatatcacataagcgtggttgtttctagacggagtattttccaaagcttgctgggaatttaagagaacctcttaaaagcagaggatgtttatgttgcattaaaacccactttcgagagaatattacttgagctacttaaataaaaatgactcttgatacattctactagggtcatagcacaaaataaagtgaatgttgtgatcgtggagttttgactcttctttcattctcagaaatgattatttgaattagtgacactttttaaaatttccaacttttattttaagttcaggggtacatgtgcaggatgtgcaggtttgttacataggtaaacatgctatggtggtttgctgcacagatcaacccatcacctaggtattaagcccagcatccattagctattcttcctgatgttctccttccccctactccctcactgtccagcaggacccaatgtgtgttgttcctctccatgtgtgcatgtgttctcatcattcagctcccacttataagtgaaaacatgcggtacttggttttctgttccctcgttagtttgctaaggttaattggcctccagctctatgcatgtccctgcaaagaacatgatcttgctcctttttatggctgtgcatactaatctgtagtgtatatgtaccacattttctttatccagtctaccatttatggacatttaggttgattccatgtctttgctattgtgaatattgctgcaatgaacatacacgtgcatatgttttcataatagaatgacttattgaattagtgacattttccctatgacatttaagttgatttttccatccatccaatcatctatgcctagaactaagaggcagtaactagcctactgaggggcttgaaaaaaattggcaaaattgctgatttcaacatgacacctctagctattggagtacccaccgttcctcctgcatggtacgaatccccacggttcaagcaaaaccagatttcttaacaatggggattatcaatttatgtaacatatatagtcctacagaacaaggtgtacttctggtccagacaagatgatataggcccatttctccctgctcttccctgataggtacaactataaaccgtgtaatgggaagcaaccaaagaatcctgaaaggtggtaagaagaatagaagaaaacttttcctctatattcttactctctaacccatgaattcttgtctaactacaagaacaacatcacagaaacccaaactaaggaatgttctgtaagatacctgaccagtaatcctacaaactgtcaaggttattttagaaagtggaaagcctgagaacttgccaggctaaggagcctaaggagacatgatgtccatgtaatgttgcatcctggatggaatcctggaacaccaagagggatgtagatgaaaactaaagaaatctaaataaagtgtggactttaataataatgtgtcgatattgcttcattagttgtgacaaatacagtagtgtaagaagttagtagtagtagtaggggaaactggatgtgggttctcagagaattctctgtactatcttggcaaattttttgcaaatctaaaattatttttttttcacttgggccacatccttggcccaaacacgttttttattctttacatggccaggataattttccaaaggtttacattctgcttcccttttgattatacattttgtctttaaattgtttctttcttctcacatttcactataaattattttttaaaaaatatttattgctgggcatggtggctcatgcctgtaatcctagcattttgggagactgaggtgggaggatcacttgagcccagtagtttgagaccagcctgggcaacacagtgagactctgtctccacaaaaaatacaaaaattagctgagcacagtggcacatacctgtagtcccagacactttgtgggctgaggtgagaggatcactggagcccaggaagtcgaggctgcagtgagccatgatcgtgccactgcactgtagcctgggtagcagagtgagaccctgtctcaaagaaatgtttattaaaataaatgaatgacctagcaactcttttaatcccttgaaattatagtaacagaaccctcgccagttacattgctgagatttgcagtgcatgaatcggagcagacctaacaggccatggacatgctgagggtggtagaagcatgtgatgtgggttgtggcacagaccatttgtgaaactgactaccacactctcatttgttcatgaaatgcatgtgagctgggtcagacagattctgtctctggggaaactaatccccatcaaaagcctatgggttggatggctgagaaagccctcactagctcttctcccaagcaaccactgcagagctagatctcgcactcaccacagtgccaggcacaaggggcccatggatttgggcgatcaaggatatttatgggccactccattgtcctctttaacaatgacactctggccttggagtgtctgtgcagttactttttaggatctgttttgggcagtgttctaattgttaatccctattagtccagggcaattttgcccatttttcctttcttactcagggatgaatctggctcatttgtgaatgaacttctaagagaggaaaaggtgagccttcagtctcacacctggaaagggaagaggatttggcatgtacaaagggggatgtgcgtgtgcatgtgcgtgtgcgtccaattcttctatgcaaatgtctctgagccccatgttctgcatgcaaaggctggattgtgtggggtcatctctgaactctcctacccctggtctgtgatgtgccagtgtttcacccacactcatgccacagttggcacaggtgtcccatccaacaagataattcactgcccaaaacaaatctggttgtattttttcacttctctgacatcccctgctttattatttcatgcccctgactccaactctctactggggctataatcatgttttggtccttccttggtgaccttcatggaccctactctgtctcatgcagcctggcttctcacgtggcttgtacagggctctccatggatttgggcaaaccctggtggcctcaagtgacagtcacatgactccaaccccaaccccactctgcccacatcctccctccacaccgaaaaggaaggtgtgtttgacagtcatgatacttgtaggagatgtggctgttccagctccttcgaagtaagagaccaagcccaagtgggaggggagatagcagtgagtttaacaactacttactgcaggccgcccacaccgggagaactaaagcggcgtctgcaggaggtgcaagccacgaggcctccctcaacgtgcaccatcaactcagagagatgagatgcaaggggaaggatgtcaaccactggtgtgaggcatctatgtcccagagagagaggagagctttctcaaagccacttagacagaacagtgacagagcaggggatgggccgtccacttcacccacattctagtttagattaccgccatcacttatcttggaagtcagtttaccatgacaattcctgacctacttcttccctacatttgtttttgttagatcgcttgactccagaatgacccttacccttgtgagtctaaagcaaaacaaaaaaatgtctgttaccacatgtgcgtctatctcaataaaaacctcaaaaaaaccccacccaaaacaataccacgtcatatgaaaatcaaatattattgtaaatgggcaaatagcatttggtagttgaagggttctcatgccatatgaataatcttccttggtgtgtatgtgtgtattgtttttagatctggacttttgtgctatcagattttcttaaagcaggattttcctgtgttaagactttggagtttgtatcaatgagctatcactacaataataccctcttatgtattctcttacgcggtataacataccaccccagcactcagttgatggcaataagcgttttttgtcatactcacaaaggtgtaagttgagtgaggttcagctggtctagctcaagctcagctggacaattactgctttagactgcacatccagctgggcttgggtcgttgatatagtttggttctaatattggtccacatgtctctcaccatctttggatcagtggggtacttggggcatgcttttccatttttgatgaaagagtaagggagtaagcagaaacatgtgatgttccttaagacttaggctcagaactggcacactggcccttctgcccacattttattggcaaaaaagatcacatgcccaagcccaacatcaatggagtgggaacaagtactttacctctagtggagccacaaagtcatatggatggcaaagggcatgggtacacggaggagtgaagaattgaaagcatgaaagccatctgctggaagcagaaaggggatggagtactgtcatggagagaatgactcaaaggaattgcattagtcggcttgggctgctataacaaagtgccacagactgggtggcttaaacaacagacattcgtttcctcactgttctgaaggcttgaagtccaagatcaatgggttggtaggtttggtttcccctgaggcctctctccttggcttgcagatggctgccatcttgctgtgtccttacatggttgtccctggtctgtgtgggtctgtgtcctaatggcgtcttcttatgacactggtcatattagtttggggcccatctattgatctcatttcaacttaatcacctttttaaaggccctatctccaaatgcagtcacattttgaggtacaaagcgtagggacttcaatgtacgaatttgggaggtgaggacacaatttagtccataacaggaattaccttctaagtaggccaaagcacgttataaaggaattttttgagttggtcattacaagatgaggagcttaagggcaagggaaataggagggatccagacatggtgttaggtaaattagaccaacttgagagagcagcttagtaaattcctttacaaagactagaatacagctttcttgtgacggatgtttaggatttcccacgacctgagcccacctaagatgcttatcactgaaataggtcaaatgaaatataacaataaaatcaaactgcttttgacaacaggggtcttctgcaaattttaatcccactgacattgaaatcagtccagttcaggccaagtgtggtggtcattttgtcttggtctataattaaactcatgggaacaaaaattgcctgccaagaggaaggtttgtcattttgagagaggaaaatccattgtaccgcataccaataggaaaggtatatgaagaaaagtataggaagcccccaacctgagtagactgctctgcctacaagtcaagaagccctggtggcctcatcctttataaaacaacaaaatccaaaaacatcaactacaaaaaactctttataatttaaactagtaggatcaataacttaaaccttaccaaaaatcaaaaaagggaaatggatgggcacattaacataactaggaatagcctttatcattcatttagaggaaatttaatctgtgtggtttaaagatgatagttcttttcttaattttaaagagaaattctcctttcagtggattaaaggttaataatggattttctagtaataaaatcagtgttaataggtctgatattgaaaggcaatagaaaccatttaaaagtaaaggaaggggaactctataatcataggcctctaaacctttttatgcctgtgttttctctcttgttcttaaacacactctgctttttaactcttgaaacttgtgggttaatgaagtggggagtgtggagagaatggcaaaatcccagcttgcaaagtaaatatgtctttttaaaaagtatgtaattcaagaatttcaagcaacaggattcaagtgggcactgagaaacttttatttcctttatattctttaggaggcaataaagaaagggggtcaaggtacgggaacactcttctgattttaagcgaatttttacaaacttttcaatgaaatggatccagactgtattagaaaatagactgcaataatgattacagcctagaagatgctgcgaatttgcaattactgtgcatggcagacaaggatgtcttttgtttgttatacatttatttattctttatgttcacatgttttatttttatttccttgttttgatgactcatctcatatggactctgagttctttgggagccacttatacaaatactttaagcacatctcttaggaagaaaaaaattttctaaaagctgttgggcatgcttgaataacatcaagttagatagggttttctcaacaaactggcaccaaatatagacacaaaacaaacttttttcagttagtcttctattctcacctctattttaggtaccatttgtcccccttcttctgtcctaagctctctgattctaagttgtccacaaacatggaaaaaataagaaaacttaaatcaacacaaaaacatttatttagcaatccattagaacaacctaaaaaatcttttctgggttttctttcaaatgacattaattgaaactaatcttgggctcttgttggtggaaaatatgtttttcttttgttttgtcctttagcatttaattttattttttgaatagataatacattcatgtgtcaaaaatcagaacagctgaaaatgttatatgatgagaaatctcactcccattccttcctctatccttctgttacctactcctctgtcctgtaggggtaacaatttttataatttcttgtatatccttttatacaatggaagcaagtatgaaaatatgttcctatattcctctttcttacacaaaggatagtaaccgtgtgcttctgtatcttaattttttcaatgagacatatagtctggagatagaacctggtctgcactggaaggtgctactcattattttttacatctccatagtattcctggatggctgtctcatagtttatttaaccagttccctattgattgacatggggttgttcctaatctttttgctattataaagaatactgcagtgacttgtgatatgtcattttatgtttgtgcaagtgtatccataaaataatttgcagaagtgagactatttggccaatggggaaatatatgaaaacctttttttttttttttgagacaggatcttgctctgttgcccaggctggagtgcagtggcataatcacagctcactgcagcctcgaactcctgggctcaagcaatcctctcacctcagcctcccgaatcgctgagaccacagtcgcgtgcctccatgcctggctaatatatctatatctatatcaatatctatatctatatctatatctatatctatatctatatattttttttttgtagagacggagtctcactatgttgcccaggctggtctcaaactcatgagctaaagtgatcctcccaccttggcctctcaaagtgctgggattacaggtgtgagccaccacacctggcctgtattgaaattttgtcagacattataaacttactttccatcagagttgtaccattgtgtactccccttaccatccccaccccccagcaatgtatgacagtgcctgtgtccccacagtacagtgggaagtgaatatactttgaaacctaacattagtacttaaagtgctcaacactcaaaactgtgtaacatatctgcttgctttaaccatcttctctaatgggacaattccaggtagcactagctgaactttctactgaatacaccttaatctttttattttaaaccttttttaaatttttttttgagacagagtctcgggctgtcacccaggctggactgcaatggcgccatctcggctcactgcagcctccgcctccagggttcaagcgattctcctgtctcagcctcctgagtagctgggattacaggcgcatgctgccaggcatggctaattttttgtattttggtagagacggggtttcaccgtgttgcccaggcgggtctcgaactcctgagttcaggcaatccacctgcctcggcctcccaaagtgctgggattacaggtgtaagccaccatgcccagcctattttaaatcttttaaattgtgaaacacaacacaagaatgcacagcttaataaattaccgtgaaatgaacacacaagaaccatagctcaggtgaagaaacagagcatttccagtactccagagagcccttggtgtgcccccttcattcccccagagaagtaactctcctaatttgaatagtatactgttccttgtgttcttcgtactttgattttctgtgtatgtaaccttaaacactttagtttagctttgcctggttttgaactccttataaacataattatattattgtctgtactctttgtgtttgacttgttttattcaaattttgttgatgagatgtatccatgttgatgcatgtagctgtagttcactcatttttattttgtctattgtatgaatatgctacaatctatcccttctattcttgatggatcagtgagttgtttacaatttggggcaactacaaacagtgctgttatgaatgcactgtttcattcagtggacccacctagataatccaggatacaatcccacctcaggatccttaacttaatcacatccttgacatccttttttccatggaaggtatcctattcacaggttctggggatcaggatatcaacgtctttggggagcattatcctgcctagcacactagccttttacagaaaaagtttgttaattcctgatcaaaaccaaaagactgaatatataaaaatcaatcctagatggattaaagacttaaatataagtcttaaaactataaaaaccctagaagaaaacctaggaaatgccattctggacataagccttggcaaagatttcatgatgaagtctccaaaagcaattgcaacaaaaacaaaaatagacaagtgggacctaattaaaccaagcattctgcacagcaaaataaactatcaacacagtaaacagacaacctacagaatgggagagaatatttgcaaagtatgcttctgacaaaggtctaatatctagagtctataaggaatttaaacaaatcaacaagcaaaaaacaaacaaccccattaaaatgggcaaaggacacaaacaaacacttcacaaaagaggataaacctgtggccaacaagcttatgagaaaatgctcaacatcactattattagagaagtgcaaatcaaaaccataatgagataccatctcacactagtcggaatggctattattaaaaaatcagaaaatagcagatgttggtgaggttgcggagaaaagggaatgcttatacactgctggtgggaatgtaaattagttcagccactgtggaaagcagtctggagatttctcaaataacttaaaacagaactgccatttgatccagcaattccattacttatacaaagaaatagaaatcattctaccaaaagacacatacacttctatgttaattgcagcactatttacaatggcaaagacatggaatcaacctagatgcccatcaagagtgtactcgataaagaaaatgtggtacatatgcaccatagaatactacatagccataaaaaagaatgaatcatgtcttttgcagaaacatggatgcacctggaggctgttatcctaagcaaattaatgcacaaacagaaaaccaaatactgcatgttctcacttgtaagtggtagctaaacattgagtacagaaagaagggaacaacgaatactgaggcctccttgagggtggaggatgggaggaggacgaaggttgatagtgctctattaggtactgttctcactacctgggtgatgaaatcatttgtacaccaaaccccagcaacatacaatttacccatgtaacaaacctgcacatgtatcccttgaacgcacccccacccccgaaaaaaaaaggttgaaaaggaaaaaaaaccctacaaactaaagattgagaaatttctggttggaatttaatgtaatctaacaggaatacagcttcttatttaagaatttggtatttccataatccctagcttttctcccaatccatctaaaatcatctcagcaaatgagacaagtgacagggccacattattgacacttgagtgctgtggaggaattaaaatacagaacaatcttttgatgccttttgcttgcagaattctctctgtctcatctgactttccctatggagttaaatattctttgcagcatcagattcagtcacaatctctcccaacaggccagcaaatccttactcatctttcagcattctgacaggcattagcattttccaactcagccagaaatgaccttactgagatcacattataaagccctgttaaatacgattggcaatagcaagcaatcaggaactacctttccagtatttactgaatgtattaatagtctgtcagtctgtctttatcttccttgtgcatttccttaggaaacaaatatttaggaaccactatttacctctcctcctttccttcttgcttttcagcaatcccatatgatagccattttacttcttccctactgaattccacaacaatgtacctgccattgtgtttggtcctaactgtaatccctcattatcagatctcaaaatgatattttgtcccacttcctttaagctgttagcactttaagctgagaattcattcaaatctcactttacatattttcttgaagatctcatttctttactcatgtgttcaatcagcatgttttgaatggcttgtcagctcaccattaatgtctcaatttctttggttatttttcccttgagggggaatgttataaatcataaaggaaaattaaatgattccaatattttaaccagttggtatttatttattcaattgggatagacaataaattttaaagcaagtttttgaaaggctgaaacattaggattccatgctctgtgtatttttttaaaaatctctaagtgatggtttcaatcaaaatctataaaaataaatctaaaattcttcttattatgtacagttaaatgaacatatcttcaatttaacctatttaaagaagcacaatataaatatttctgatgaaaaattccatactaggacaaacccttgctatcctataagacagcttaagaatgttgcctaatcaagaaatatcaaccccccagggaagtcactagtgtgaagctaaagtgctcaccactggggtctcttctgctttaatattttggctgaagatgtagacggcatgtatatctcttctgcacctgacttgagacagggagggatctcaggaatcccaggcatgcaggttgaaacaacgggtatcagctaggaggctgtgactataagctgcaagatgatggttggaggtagccaaagactgtcactaatgaattgcctacagaaagcccccgtgacaagggctttgttaaaagtgtccttcatcggggcaaagggagtggtgcagggagagagagagagaaagagagagatatgcagtttccaggagaaaatttcaattaaggcagggagtgtggtgaagctgggacgtggaggcaccagtcaggaactggcagggagagagaggacttgactggagaaggcatttggggattagctgaatgagagcatgaagagaatgctcgatcaagttaagaaatcccaaggcaagatcagagcatcactgctgcatagaacaaagggtcaaggggtctgattataggaagtcccctctggaagtccctttggaggcagccagccctcttcagattggatacaaagctgcactcagactcaatattagcttttccttgagtgtctgtattagtcccttctcacgctgctaatagacattcccgagactgggtaatttatgaaggaaagaggtttaattgactcacagtttcatatggctgaggaggcctcacaatcaatcatggcagaaggcaaagggagagcaaagtcacatcttacatggtggcaggcaagagagggcatgtacaggggaactcccctttatcaaaccatcagatcacgtaagacgtattcactatcacaagaacagtttgggaaaaacccacccccatgattacaatacctcccactgggtcccttccacaacatgtgggaattttgggagctacaattcaagatgagatttgggtggggacacagctaaaccatatcaatgtcccacaaaattctcttccaaatggtttttgtggtcaaattagtttggaaaatactgcataccctaccatctcttggagtttttacagtgatacatatttacagtgagtttttagttaaaggctcaaaagagtgattagctttagttactccagtgtattaatcaggagaggacaggttatgctgtaataacaaacatccctcaaatgtcactgccttcaaataacaaggctttatttcttatttatgttccatgcccaccaaggatcagctgaggttctattccttgtcatcactggactcaatgctgaaggggcagtcaccgtgtagaacactgcaagttgctgtaacagagggaaaagagaatgtggtaaagcatgcacttgctcttaaagcttctacccaaaaatgatatgtacccattctgctcacgttctgtcaaccaaagcaaatcatgtggctacacatggcaggaatgcagttttgaactaaatatgatgaaagattttctgaaaagttgaataaagcccctcttctgactatggctcacaaggccctacagggtttggccccaatttgctgcttcaatcaaatttcatgccattctttcctacctctctgagttctaggcatgctcaccattctaagagtgcttaaaacacaccaggctcttttcagccacatggcctttgcactttatgtttcctctgcctggaagtttcttatttagcttttgcattgctagctccatcttgttctgggctcagcttcaacatcacctccacatggaggccttctttgactgctcactctaaattaacatccacaactcatcacttattttctctcatggtgcccacctattttagttgtatcgtgaatcaccagttataattacttcatttatttatttatttttttattaattatctgactttttaatccaaatataagtcccatgtgggcagaaaacttgtctatcatgttcaccctaaatctctagcaccttgtacatattaggtgctcaatatatgtctgctgaatgaataatatgttcttttatggttattttttattacagacaatttcaagcaagagtagagagaatagtataactaaccctgatgttcccattgctgagtctcagcaatttgcaactcatggccaatctcatttcatctcagttcccaccctcttctagcctcctgaactattttgaagcaatccaagacattatatcacttcatctacaaatatgtatctctaaaagataagggttcttgtaaaaaataatggtaatacaatgattgcaccttaaaatattaatgatatgaacacttacagctgtacacagatggcacaagctgcctcactaagaaacgagagcctatttgactgacgaatgtttactgaacctttactatatgccagacaccattttcacagtgataaatacaggtaaagtccctctagtgatgttctggggaaggggcaacaatcagaaataggagataaggcttccttccccacagtgctcccccaacactgtgtccaaggcagtctgcggaaaggattctgcagaaaggatttctgctttgctgggggactggccctacttacggattcttactttaatgatatttttactttcctatgaaccaattcctcatttacatctcaaaatatttatatgaaaagcatttcctcctatttttctttgcaggaagtaacctgcatgtttctgacttctccatgccttacttcttatatttaccaaacaggccactaaggtggccaaggtaagtggctagggctgcccctagtccatatgctgtctctgtgtgaattagaaaaaggcatggcttgctccagacagagcagccctgtatcagggtgcatggcttggtatgcagactacagagctggatttcagaccctccttccccatcgaccaggcacccaccctcgcgtggtaaacaacctctacaacggtacatgggtgacctgcagggggctatctgatcaaggtgttttactgactgctttagttctatgcaacttatgttgcctggccccagacacaagtgattcggtaaaaccactacaatgtaaaggtgagaaatggcatgtgatttgtgacagatatctgctactcatttgtcaaaatccactgtgtgtgagaaacagttagtgggacagtagtgttatgaatataaagcatggtattttacaaagagcctgattctactgacagccaactatttgaattatttcataaaagtgtggtatgcctgtctcgttctgatgcatttctaaaaaatgatacataggcaataaatccaaggcttatgaatccacttcctgtcaagaagtatatgtcattataatgtctgttgtcatggaaatagttgggatttttcagacatacgaacaaacctaagtaggttgaaaatgtgtagatgtgtcacactcattctgtcccctaaattaaattttttttttccaaatgggggaaaaatccatcgcaagaataaaaaatccaaaaacatgttggaatagcacactttcagtttgagaaagctagggtttctccccacccctcttcaaacaagcaaacaaaaaccaaaaagtgatagttctatgtgtccaaaaaactagctgaagttctggactcttgtttaccttggtatagaatctttatgacaggaggctggatgaatgctacgtgtcaccttgctctctgcagggatgaacaatttggtggtgtgctgtccaatgtggcagccactagccacatatggctattgagcacatgaaatgtgacagctaatcctaactgagatgtgttgtgagagtaaaacaaatgctggatttcaaaggcttagtacgaagaaaagaatgtaaaataatagttcatcaataatttatcaatattgattacatgttgaaatgatactattttagatctattgggttaaagaaaatatgtcactaagattaattttatttgttcctttttaccttttataacatggttatttgaaaattttgaattctccttgtggctcacatcatatatttctttttggacagtgctgatatagatataagcagcaccagcatgatatcgaagtgtctggccaactgtaacaaccaaaaactcatccattcttgtgcatgttttatctgtttggcagccagttagattgctggcctggtttttttctgggtagacacaggcaaagagaaaggcattgtggagatgaggtgggtcgggggtacatgctttacaagaacaggttttgtagcggcatactcactaggtgacttgaggcaaacatcaatgaaacccccaactgtttctgtccagacttccactcatggtggtgcgattgtccctatgggctctcctattctctgtggagcatatcacattatctaagacagtcaagcattggagagaattgtaagattctgtcattacatggtaatgtctgcaaaatgcatatatatattttgttttatatgaaatttttggacaggaaaagaatgaactgaagtcaaatgaatttggaaaagctggcaaacttttcagagtcctgattagtatatttcattgcaaatccattttttccccataccatctgagacagtccagatttctttctttagggcctataaggtgcaaatcttttaaagaagaaaaaaacaggccaagcacagtggcttacacctgtaatcccagcactttgggaggctgaagtgagaggatcacttgagcccagggttttgagaccagcctaggcaacatggcaagatcctgcctctacaaaaaattttaaaaaattagccaggtgtggtggttcatgtgtatagtcccagctactcaggaggctgaggtgggagcatcacttgagcctgggaagtcaaggctgcagtgagctgtgattgtgcaactgcactccagcctgaatgacagagggaaaattcatcttaaaaaaaaaaaaaaaccctgaaaaaaacccgccactgagattcctgggtaatacccatgtgtatatggactcggttactgtgccacattacaacaattgctaaatgccccttgcctggtgggtgctttatttatataaactcttttcttattatattcttgcaaggtaggtattttcattccattttaaaaataaagaaactgtggttcaaatgctaatgcaatttgcccaaggtctcaaagcttctaagtagcaagtagactaggaggatttcaaaacaggtctgtctggctccaaagtctaagttctttcccttggaactcattgtctccttttcagacacgcagcaagaattgcttcagagccacacaattctacatgtacaccgaaagtgcaggcctgctctaagggttgggttttatcctagattctgagaggtcctcaaagtgggagagtcagctgccaaggattaaagggcaaggaggaattcaatgaaggctaggagtaaagggataagaataggactataagccaaaacagcaagctctttatcactgtcttggagaccccggggggatcatttaattcctctgcacctcactgcctctacctgaaaaactgagatatttagccacttggtctcatttgtagggttgtaatgagaaacatattagatactatatggaaagtgctttgtaaactctaagttctataaataaggtattattaaactaaaatttcacatcatccctatttttaatatggggtgattgttggttcgtgttaagtagatagtagtcaattgaataaagaaagcttatttgtttgtgtacatctcaaagagaacaaacctaagtttcatcatctagaatggttatgagagacaatgagttttaaacactgagtagtggtcatattaaaaactcaatggcgagaaactaatttctatggccagaaaggagcgtaaagtcacttggtccatacctggaaatattcttattcataaaatataagacctatttgaattaaaccacacaattttactgtggatataaaatcacacttgaatgaatcatgaagacataggatattcttggatggaaagacttaatattacaaacagtaataatgattctacccagattaattgatatcttcaacacaatcccaatcaaaattcccatgagacattattgataatttaatacaataatttaaaattttatgtggaaaagtaaatgagtaaaaataagataattctgaaaaaaaggagagtaataagtggaagattggccttcagggaagattcctatcttcctttcttggccccaagtcttcatcttcccctgtatctgcatcttttatcatgtgactttgtagttcttctgaaggcctcttaaccttgggcttagccacgtgtggcttctcatggccaatggaatgccaacaggagtgatgtgagtcagctctgagtctaagccttatgaggccccacaggtttccacgcgttctctcgctcctctgccaatgatctgtggagaatccatcctggctagcctgttggttaaaggaagtgacagatgtggaacagagccacctcagatgactcatagatctgcagtggcaagcccacctccccagtcattgcagcctgaggcagacccacctagaagagttgcatcccagtccctctgcagatgtctgagtgctagtaaatgattgttgtaagccactgagctttggagtggtttgtaatgcagctataactaactgattgacatggccccaccacacttgagaactattgctatagtatagtcagtgtgaggcagagacagcattcaaatctgggtctgttatactccaaagcccacaccttcctttcctgaggaagtgaattttaggtttgtgtcaaagggtatgatatgatcattgttcactctctgcaggtcattcctaatagtgtttaggaatgaaatccaaagacctactttgtcatgtgacctgtgatacaaatgcccttgttgagaaaggggaatagatgcaaaatcgattcatgggctccaaacttccaagactgtaagtggttgatttcccttattagatattcagtccacggcatatgggacaaaatgaatcttctttgtcatgaaactcctactcccttctttccacagtggacagaaaatatgcccctaaaacctgcctccttagatggcatcttttcctgatggtattttggaagctgtgaacctgctcgggaaggataatgtacaatatctcaggcaataattcctgacttatatgggcagagctttttagttagaaaagaaaaacaaaggcttctatgttaatgtttgacacagactgcaagaatctttcaggaagactccattgtcaacttctcagcaactggtaatgactcttggctcccacactacacatttctgtggctgcgcagcagtatttcagcttctttcagtatctcataaaaatcacagctaataaactccaatcagcacctgaaggaaggggtgcttgcttctgactgtaatatactgggctctgcagcacttcaaaggcgaggcagatcctcctgtctaccttgccccagtttctatccctgagtgaagattaaccatgtgtgctctgggaaaatctggtctgagtttgctttaaagcctttcgtatccctttaaatcagctgttcagttcgacagcccactaacatagtctccctttgcagtagggagagggcgtgttcttggtttaccattggatcctttcatttcctgcatcctctactatgcaccccgtgcttccagtttgttctttgcagaagacgaagcatgtatacccatgagagaagcctgatcattttaaagtttaatgacaagtcaaaactcaattcgatatttattgggagcctggctccagatacttgaaaaacagtttgctcttagctaaggtttggtgtcagatgcacagtctcaaggtcacgtgacataaatttttatggaacttcgactgaaaaaatgttttctgtgtgcccagagccctcctccctgaacctttaattgttactgtgcctttatattgggatcacaaagtttgggttctcagaaaacactttgtgaggatgcacaggctatcttttaaaaataggctgttttaaaatatcagtttcttctttcaccacatctcagaaatattcagagtgttgctgaatcctggcaaaatgagagagagcaatacctactgacagtaaaattagatgaaaaatgctatgtcacagtgtgatggtggtggcattacttagtgatttaggggtaaagttcctcaagtttgaatcgtgtttctcattactcccaagagaagacataattctcaggcttgcttcaacatgctttcaaagagataaaagaaacaaacgtagacctcatgaaacatgtccaatcatacctagttattacttttaaggcaaaatatacctcttattcctctaatgagatattgacaacaagcctatagggatataaatattccagacttactgaatccatcaatcaactatccaggagatagttttttcccccctacattttaacacctctgaaatcaggatacatcctgatctggtggatggtaccttagtattgtcatcagccaggcagtgggcattgtctgtgcatgtgcaaacttgagctgaaaactttcagtgtctccttcaggtaaaaatctagaaaacacaagcatcaaaacttggagaatgggcatcagtggcttggaagaaaatctcagagatgacagtggagcacatctctatgaaaggctgtatcatcagcttttttttttttctgacatagaggatgatacattgtggaaaggcatgggtatctctgattttcagttagattaattcagaagcctcaggctcagaccttttaatgtatgttctagagtagtatatggaaaaaaacccatatcactaaagtcaaaatgaactcattcaataaagagaaaacacaagcatcaaaacttggagaatgggctccagcctatgggtactactggcatagttccaccctgtggctcagtggctgacaggcagtaggattctccttctatggctttgtcattgcatgtgtggctgcctgagtcattggatgtgggtgctgaacccattagtctgacacatttatttgccactttgtcaggtattttaccctttctggtcaaatttcatttcttgaaatatttcagttcaaatgagtcttctgtgaagagagagagtttagggccacccgtgagtgataggatttttcacagcctcaatgttcagagcagaactgccgacctacaagtgtgtgaaaatatccttcaagtgtcaaaaagctgtcacagggttctggaagaggaggagaaatcctcaagcttgttctgaaataattaggtgcaaaataaatcaggagcttaggagaaataatgtacacaaattagcaaaaagcaggagcctaagttatgaaaagaaaaaaaaaagagctacaagaattaatacatccttgtccagaactatgtagaaatgtgatagctggagtcttgatggataagtcttttcacttctcaattcctcaattttcttatctgcaaaatggggtatgcctacttcattaggtgaccggaacaattgaaatgctttcaaaatgcttatgtacaatcaaacctatcacattgcaataactaaatgtgctcaggatgctatatgactcaataatctctgaacatacctgtctaaatggatgttcacaatgactttaaatcatgaagtaagaattaaatatgttctaagtatttttttttaaaaaagggagatgcaggctgtattttagaaagatttccattaaaatgcttatatatattttggaactgatcggtatatttcagttattttggataattcacatacatggacagcctcatcctcaaccatgctggataaatggggcatggtggtaaaggcatagtctaagaacttcaaatcagacattgggagaattcagtgctatgactcagatagagaccttgtgagtcatgtggccccaaaaggggctttgaagctgagccttttattttcttgatatccatataaacacagtaaaccaagactattttaactataaattctagcagatacttaaaatgaaaatgtgagaagcagaactccataatgggtaccccccttaaggcttccttattgactccaaaaaacagtgattcccacctgctgttattggcatataagaaactcatgcgtaattgtgcatttccaaaagtggctgagaaaaggtggtagacagaatgtgggaatacactaaatacatagtaaaagccttgtatgactctgtttttagtatatttctctgcttctctctcatctgcgttattcattaaaatcacctaaactgatatttatgtaagtcatcctgccctgccatcattctccaatgtgaattctgcaaattttctggttagataaggagaccactccatatctaggggtccctaatgctaaacacatttccaatctttgaaacttaggcaagttttcttgctctaaaacaaactgctctgtcctagacagtatttccaatttaaaggcatatgactagactttcaaagagcaaagggcgaagagtatgttttacaattttccttaggagccttcctagggcttcctcctaagaaaatttcaggaaaggaatttgttctagacctgtgccactggccactgtggcttattacttgaaatgcggccagtccaaattgagatgtgctctaagtataaaatacataccagctttgaaagcttagtaaaaaaagtatctcactaaaattttttatattaattacacgttgaaattaaaatatttggggttaaatgaagtatattgttaaagttaatttcacctgatacctgctttttaaaaatgaggctactagaaaatgtgcaattgcatatgaggctcacagttgtggcttgtgtatttctattggacagatagagcataacaatgttggttcaccctggcctggttccttgattcaagtccttttaggactaagaacctgagagtgggaactgggagatactggttctaatctaggctctgccactgaccatgtgaatctcccctgagcctcagaacctgtgtccgtggtttaggggcaatgagacacccttgacacaccttacaggttgactgtgaagatcaaatgaaattatgttggtatcatctaaaatactctcaacagaaaatatttattggaagtgtttctgaggcttcctgtcattctattcccgacctcaagggaacatatcttacattacatattacctgggaacatcatattccatccacagcctgtacttactgtgtgattctatatggcagatattgtgctgaggacttgataaatgttagctcatttattccatacatccaacccgtgagactgacactattattaatgagaatcagaagagtgtggtgattaagatcaggtgctctggagccagactatttggatgcataactgagagccaccacttaatagctgtatgacattgggcaagttatttaacctaagccacaggttcctcatcagtacaaagcagggaaaataataagactgcatcagttagggcgatggtagatgctgcaacaagaaaaaaccagatgggcatgatgactcacacacaatggaacacttgcccgtataaagttaaaactgggtattccaagcagggcttcaggaatgcaagcttctttatgtttccttagaatgactttcaaagtcactgagcttgtctgcattaggctggaagaggaaagaacatagatgatgatgtatggaaggaacctgaggctcagagagacagagtgacttgtcctaagtcatacaactaggcagtggtggctcaggtgcacactcatttctgtctgattctggagcccatactgtctacacagttcataagatgtgcaggaaaacaagcctaatcacacaagcatatttcacacctccatttgcaatatgcctgctaacagtttattggccaaagcaagtcacatggccaactccaacatcaacagggatgtattctctgcttctagtggtaggaactacaaagacacacggaaaagggcatgaatgcacgtaggggtgaagaattggagctatgaagaaatctactacagttggtgagtgaccaagtgagaatcagaactcacagcccatcactcccagctattagggagcccaactcactgcgcacagagctaagtactaccagaaatggatacaaagttggctgcttgccttggactctgcatccaagaagatggaaaaggaattgcccagtgtctccgttggctttatcctagagagtggaaccatctttactttttctcactgctggccccccacttctatttggaactttacaaacccttcattagcttaaagaaacagctcctaagacagagaaacaaaaactatttacaaacagaactgtggaactcagctgggagtcaagagctgtgggttctgattctcactcagtcactcaccacccgtagtagatttcttcatagctccaattcttcacccctccgtgcattcatgcccttttctgtgtgtctttgtagttcctaccactagaagcagagaatacatccctgtggatgttggagttggccatgtcacttgctttggccaataaactgttaccagacatactgcaaatggaggtgtgaaatatgcttatgtgattaggtttgttctgcacatcttacattctccatgaggaaaaaaagcaacaacactctgactagcttagcccgctggtctaaggggtgagaaactcatggaaaagaccagaaatcaaccagcagcttggtactgagcccacctgagtctggtctaaatcaatcaattcctacccagagaagagtgaatgttttaagacactgaggtttggggtagtttgttacacacatcatttcggttatagctaactgatgtaccaactatgagtaccttcagcaaatcatctctcctctctggaactcagtttacttctctattcaaggaaggcattgaacaacatactgtaaagccccttccttctgtcctaaagacaagggcaacataccttgccatgttttttttccccaaggctttgtatattagggaaggaatccatatgcaggaacagaagtgaggctcttaagtgaatatcctttaaatatgatagttaaacaattatcttattagcatttagagctacaccgtattaattcattttctattttaatgtatagaaacagatttcgttagctttcagatgtcaaaaacctgctgttctagtcccttccctataaccagaaggggctggttctctggcccttctggcagttcagaaggtagggcccagaggctgctgagatggcagcaggtgtgcaccattcagtctccagcctggagaagatagaagtctaacttcagaggtgttagagaaagccagtcagtcgtcaaaaaaggttatgtccatctgtcttctttccaatggtgcttatgttagagtgggttccgaggagatatacagccatggagttttacatatgtgccttataaatatggccattgattcctcagaactggcagtgattgtggtggcagatttattgtatgtgccacaggtcaaggttcataggttactttccaaatatccttttcaggtgtctgagaattcctataaaaatatacattaaggcacagggtactttgaggaaagttagtttattacttgccccacttggaacccaaacgaaagtaagatacatattctctctggggtcgccagatcctcatgtgccctgatgaagtttttggcactgagtgccaagggccaaatgggctggaactctatcttgactggagttggatgcacccggcattctgtacccgacatatatcttctgacacttacttgtgcagcaaaataaattgaatctattcatccctccactttctggaaaagaatggcttcttcttgcatatgctcagaaaagtatgtacaaggatatactgtaaccttatttttacaggtaaatgattagaaatgactggtatgtccaccaactgaggaccagttaaataaagtagcttctgaggtggtatagggtagtactttatatgaaagtatgtggagtcaagggcctgagctcgaatcccagtcatgttgattactcacttggatactgggcaagttatgtaacttccctatagttcagttcctcgtgtgtaaaatgaggatgatatatctctataaaaatgtttagagttagtaggaactaaatgagtcaacatgtataagacacttagaacaatgcctggcacatagtaagcatatagatatatggtagctattgttttaaatattatttaaaaggatgaagcagacttatatactctattgaaatggaataattacccccaaacttagtggcttacaacaacaaccatcctttattatttctgatgattctgagggttgaccaggctcagctgggctattcttctgccccagatactgtcagctggagctgaagtcatctgaaggctcaactgggctggaacatacaaaatgactccctcacataactggctgttggtgctggctggggttactgtttagagcaccttggatcccttctccctacaccttgggattctcacagcatagcatctgggttccaagagggaatatcccaagcctgtgtagatgaaagttgcaaatctcagaaagttcctccttggaagttacactgagtcacttctgtcacatattattcgtcaaagcaagtcacatgcaggcctagattcaagaggagaggaaatagacttcaactgttaatggcagtaatggcaaataatttgcagccatctttattacatattattaaacagagggaaaaaagtgcagaaggggtggatacattatcatttaggtaacaagggagttcttatatgtatatacatacatgcatatatctataataacatatataaaacaacacatataacaaaaatatgtatgtaaataaacaagtatatgtatgtgcactgcatagaatcaatatcttcaaaaacatgaggatctggtaacagggagagggactgggagactgacatagaagattgactcaattttcactgtatgccaccttgcattgtttgaatatttttcactatgtccacattttgtttattcaaatgaataaataaaaatgcaaggaattagcaataatagtaaagtttcagcacttctagtatgaggagaaatcatttctggaaaaagcaactccgtgaaagaaacttttccattctcctgacagttatcaatattaaatagctttggagaactttgagttgtcctcactgaccacagaggtcccactgtccccccacccctgacacacatacactactggcattttttttttaaacttctaaagtagttcttgtgtctgtcatgttctcctaagaatcaggttgctggataattggaaaacatttttacattccaattttaaaatcatcatttatctgtgactagcataacatctcatttatgtttaaaataaaagagagcagaagcactccctgaatagggaatttgttaatacggtatcatatctgaatagaaacatagctgtggattttagcatcattgtttggtcactgtggttttgtgctatttccctgtggtattagatagttgcagggaggcttaaatttcttcttttacaaagaaggagcaaaaacagaaagtaaagacacacattcccattcatctcttgcgcagcagtaagagaagacagaaagtcattccaaggcaggggatgagaaggttctgtctcttctgcctctgcttgttgtgtgagaccctctcattctgagagctggctagtggggcccctgaggttggagagagatgattccaggctccgcaacttatgtgcttcttgttattgctatgtttagactttcattctgggattttgctggttcataacataatctattgcatttcatttttaagagtcttattctaacttcatggatttggcaagtgtcccagatttttcactttcattctgaatttttaaaatattcattttcacctccacttgtgaccccatttagcatgatcgtttgaagaaaggccagccagactgtgcatgagtgaatttcaagcatgaataaatcaagcaagagccaaagtgctagtcaaagagaatttgagagatcacagtcactttcccattcccctttgcccctaaaagggaattttaggggacattacaaataatccgcttgtctataatcatcagcatcatcatcctgggcccacagataatgtgatacagttgtacttatttattcataacattttgaagctgaaaggggtcttaaagattataatgaagaaacacaagttcagagaagttaaggaagatgcccagagtcacacgggcagttagtaaaatgttccaggttttgcaactcctaatccattgctccttttctggtaccacaatattacagttagtatggtagagtgagatgtcacctttgcctctctcgtggttacgatacaatgaaacacaccaggaattgctgtgctattagaccattgggcagggctgggatgcatattgggaggtgaaggttctctattcaagcttcaaccaaaaccactctgcttatgtccttagtatttgtgcttctggataagatttctttggaacaaagggttctatgactaaagcatttggaaaccacatcaatttcaatcccaatttaatgcagggtataggcttaatagaacatgtacaaagcatacatagaaagctccctagcacactctaaataaatcagatttgtaactggatgcattgtggacctagttaggattctgagtgaagtgagcaagtccttctcagcactctctaagttctgatgtcctttttcttcctccatctagttgaatggtttccagctgggggcaacttcccccctggcccaggggacatttggcaatgtctggggacattcttggtcatgacaactcgggaggggttgttactgatatctagtgggtagagaccggggtgctgctaagtatcctacaatgcacaggaacagccctcacaacaaagaagtatctgccccgaatgtcactagtgtctaaggtgagagagcctgctctagttgaaccctatgtatcagtcagggatagcccaaagcctgctgcttctctttggtgttttcctggactccaccagcccttggtgcttggagattttatggtttctaacttcccaattttgcagttaattgaataattgtcttacttgttcataattttttcaagccacaattagtcttagctgctcaactggattattagtgtattgtaagaagagtggatgttttatgaatatacttgttctgggtgccttataagcacctaatcttggctaaacatataggaaatgcttttctggggaagatgtgaaaaggaaaagttcagaatgcccaggtgaccaggggagcagcttaagcaaaaaacaaacaaaataaaacccaaaaacccaaccaaccaacaaataacaatcagggatcactaataaagaaagtcagtaaatttttttagctggtgtgagggtgatgacaaagacggtagtaaaaggcaaaaagatatggggaagaggtaggggcaaaatggaagggaactttgaaacccacagaggagtaaattctagaaatgtgggtaaaagggagcctctgaagatttcattcatttattcagggatgctttctttgatgccacagtcagggagaacctctcagaggatgtggcatttgagtattgaggtttctgtagaagaatgtgactttatcagcgtgcttagtgacttcatgatacctcacctattccccttctccctgcagagccataagtttgggaaaaattgagattctgttagaatctcctttctctccctcagaggagcagctggtgagaagcctgagaggagaaaggtgaaaagagaacaaacaagtttcttttccccatcacacccctggggcctagcatgtggtttgaagactctctaagagtaaagactgtcaccatatctgtggtggaaccagcatcctacccagagttggctggaaatcctgacgctctcccagagatgtattgtagattattctagaagttgctacacaacatttgcctgggacacttaagcaaagcagctcctactttaggtcataacattcttcacatgctttctgggttgttgtttaaaaaaaggcatccaaataggattttctgttttcaaatcaatgcccactgaactccactattacaaactggtgttggcctaaaagtgtggcaatttggttgagaaacggttttcagtttgtaacttccatgagtagatgataaatttccagttgtaaaaatgctggaaacattagagaaatgttttcaaactctgcttctcaatcaagccactgacttaaatggaaaaaaaaaaaatccccctgtacgccaaaaaaccacacttcagatgtccccgtcaactgcgagacatttgctttcccatgaagacccaccatatggacagtatgagaaatcgcaaattaaaataaattgttattcagagagaggctttcatttgagccaagactcccaactttacatcttgcagcctttgccacacaattaggaggtccagttgggttgtttaaaatgtttgtaatatttaactccccaactgcagcaagctttgttttaatctctcttctacaccgtagcagccgtgtagccagcatgagagaaaacaggagccctgggccccctcttcctgcctcctgcttccccttccttcactgtggcttctgggcctcagatgctaggctgggctgctaagccctggaggattaagccctcactttaaaatgctgtgctggcttaggctaaggcctagtgggggacagagggagaaatcgcctgggtggaacccttggttcagaatttgtggtcactgtgacctgcagggaagttgtttcagccactgtggaatttgaccaggaagacagactggccttggtttggcagcatttggcatcaggaaggaggacgttatattctcccctctcttgctgctcaatgctaataggccaagcttgctctttgggggttttctgcttgagttctgcacctctgatggtttgtggtcattagagatggagacaggaggcaagtaagctgaggaaagggttaaagccaattctattagtctcctaggcctgctgtaataaagcaccacaaactgggcagcttcaaacaacagaaatgtattctctcccagttctggaggccagaagtccgaaaccaaggtttcccatcaaggtgtgtgtccatcctgttacagccatactatgtgacctggagttccctaaaacaccaggctgtttcatacccctatgactttgtacatgccattctatctgactgttatttctatttgacaaattttgactcattatttcacaaaatgttacctcctgtgggaatccactcctgatcatcccaggaataggacctcccgttcgagggctgtgctccctcgaaagccctagggatgatactgtcttgtctctttcagcttctggtagccccaggcatttcttggctttgtggcaacataactctaacttctgcttctgtcttcagttgtctgtctttcctctgtctgtgaccaaattttcctcttcatataaggacacccattgtattagtccattctcatattgctataaagaactacctgagactggataatatatgaagaaaagaggtttatttgtctcacagctctgcaggctgtacaggaagcatggctaggaggcctcagaaaacttacaatcgtggtggaaggcaaaggggaagcaggtacagtcttcacatggtggagcaggagagagagagagagtgaaagaggaagtgccaaacactttcaaattgccagggtctcttgagaactcactcactatcttgagaacagcaaggggaaatctgtccccatgatccaatcacctcccaccaggtccctcccccaacattgggaattacaatttgacatgagatttgggtggggacacagagccaaagcatatcaccagtcatcttggatgagagttcatcctacttttggaggaacacaattcaacccacaacaccactaaaggaaggaagatttttttccagtgaagatgctccactcttaacacatgctccactcttaacacatgctcagggccttggtgcatatggcgcctgggtcagggacttatttcccaatacaagagaggaccataccaagtctttcctgtgagatgtgaggaaacagctgactagcacaggcccagattgcaatttccaagatcaacctttgctgaaattcttgctgcagtcacaaattcaagggtgcttggaacaatagcctcttgcttttggaatcttaactcttaaatcctccagctcctggaggtttaaccagacctgtagtgttattttaactgtgtcacttgtgattgaatgcagtttatgtatggccttgatgtccgatcagaagcaggattaagagggctttggggcttccctaatttatatctggctcaaaaggcagaagaattctagttgcctttctgccattttcccagtggtcatcctctcttgtccttcctctcctggctggctggagcaaccacataaatattctgagctgctctcttgtctgcagagctcaccccactatgagcaaaggggcatgtggccaccagagggtggggagttccccaatgtcataaaagtccataaagaagaattcttggttaaaatcttctctttatttccgcagccctggcaatctttctctgctactttttttgatgttgcacccaatttttaccttggggcaggcgagagagggagggagtgggaattgtggcccaggatttggagataaaaatgggttgttgttccacctctggaagatttccttcctccagtggtttctttcctattgtttcacaacaaagaaaagagaggaaaatacccccaggctaaacaaacccttgttccattgcagtgcctgtgggaggcagcaatatttttcctgtcagtgttttgttgtctgcctttcagaaattctatatactttagttcaccgtctaccagggtttttttcttagaacagctaacccagaaccaaaaatacatctggatggctgctccttatctaagaaggtcaaggtctttattagtcccacagtctagctgagaaagagacaggagcttaaagtccaacagtctggaattttattgtgagatagaggtggcttctgcataggctctgtctcatttggccattttcacaagaagcatctgaaagttttgcacagaccttgggcacaggggccactgtaacaagtacactgttcttgttcacatggggtttatcttgcagctgtggtctgagacggtacatcaagtctttggggaaggggcatgtattagtccatttctatactgctacgaagaaatacccaagactgggtaatttataaagaaaaagagatttaatggacttacagttccacgtgactggggaggcctcacaatcatggcagatggtgaaggaggagcaaaggtacatcttacatggtgtcaggcaagacagtgtctgcaggggaactgccctttataaaaccattagatctaatgagacttattcactatcatgagaatagcatggaaaaacctgccccattgattcaattacctcccactgggtccctcccaggacatatggggattatgggagctacaatttaagatgagatttgggtgaggacacagtcaaaccatatcggggcagaagattatttccgttgtgagcacttcaagatttagaaattcaagcagttcctgaaaaggagaatgagagacgctgtgcagactctgatatttattgatttgtttcataggctcttatatgacacatgtggcaccactgtcttatgcactttatacatattaattcagttactcttaataacaatcctacaggcagttactatgaatagcaccatttacaaatgagagtaccaaggagcagagaggttaggccacttgctcaaagtcacacagcttcatagttggcagagttggaacttgaatccagatgtctggctccataatgcttgcatttcaacactaaagtcaagggaaaatggtaagatttcgagatcgtatgtcttgagcattcccagaacaggcagatcaagactatttattctacggtttcaagatctgtccagaccattaaccacaatggcattaaaatggtctggacagacctggaacccctgtagtattcttgattggtaacatggaattattctgcctgttcaggaaatgctcaagacatctgattttgaaatctcatcaactcctctttactctagtggctttgaaattaaaatatttagggagaaaacttccaactctcccaacagcctgagtaggcgctgacatgtaaataaatggtcttgtaagaagtggtgtgggtgcttggacctgtgagagaaagataaggaagttttagttttgatcatcagtacccacaatgaaggatatgagacccagtgattgcaatttagtagggcatggagtgacatttctgacaaaagatgtggcaaatgaagagttaattcagattttttcggtcatatcacttctttcacactccttctaaatactgaaaagtcaagaaaaatgtagcagttttcccttgcaagtcaccatcatttgtgttaatctcccctcctcccactgccccaaacaggggaacagcaatatcacaccacaaagtagcttccagaagatgtgcagcatgggactgtgagaatgccagtttcaggggctattttgctgcgttgcgttctgtgacagcgtgatccatcggctgctcttacgaagacaatatagtaaaaagaattggcccctgctggtgcttaaaaggtgctagaaggggagtgttaatttattgctaatatacactgtgttaaaaatagaaagaaaaatgtcttttggtcccactttgccttttggtgttcaaaaagggaaggggagaactagtggccataattagaggtcacattttggtcacaacttcaagacctcgttggctgagaggtaggggaaagacatcctttgtttgcctgtggggaagggagctcctggcaggagctgtcccctgcagaggccaggatgctcttgccacactattattggggtcatttatttcccagcatcagacctcctgaacttgcatttgcattttcttcctgtccacctgaagcagcactaatgggccccagaaaccttctggagtgtattgggtctgctggcgacaggcagagaggaaacaggctcaggatccttgagaccccacttcagggatctggaaatagagactgggaaagaaaaatagcccttcggagaggtgcctaataaacagtctttggattgaagacttgcggactcagagtggccagatgggaacaatatttaagggagatgcgaggaggcttcttcgagcttcagaaagttgatttcctcctgcacttggatattttgaaaagctgcttctgggtgttataaccctgagaaatgagcagacccaaatgggaaaatcagcttgctgggtctcccctaatttctgctgttcggtctcagggggctggacctggtagtgccaacccctcactgtccctcatttcgcggaagcccgcagaccccctgggaaattaggcttggctgcatttgaaatagcttcagtgataaattaatttaattaacatatctgcagtttcaactgcctttaagataatctccctttataaaaactcacatggatgaaggcaaatattgatgtggaaatagcctaaaattgcctccctacccaacttggaggaggggcaatgatagtctggctctaactacctatactgctcttcaggagatttctacaatatatgattctttttcctagagcaagatttaagtccatttttcttcctctggttcccccactgttgtcttccttcttctctcccccagccccttccgatttatctcaatcctttgaaagtggactagcccaatctgtacctgaaaaaaaaacaaaacaaaaaaacaggtggatggatcggtgggcgagctaggtggtgaggggaagaagctatcttcgtcacggggccaggaaggtctgagaaggcacaattaattcctcagtgctaagtgtcctttcctctggcctgcctgcctgagagtgatccactttcgatttagtcatgttgtgtgttgtccgtggctcaggcagaaaggtcacccacttagctttctgtgccatgaagagaaattagtcaggacctccccgagagggtgcggctcttggctattcatcatttggggcaggctccatggctcctccctgagcccagcatttgataaaatgaaggtgttgctattagctgagggctggggaaaaggctgtgtgttgcatcctttcagaaagagaaggggtaggggtgggaggaggctttagggaggaaaattaggtaataaaaaaataaaaataaatatggaacacaaaccacaattagacctgttattttgaaatttatgtcatacaatttggaaccacaggtaaaaccttccccctccagtagtaaaagtgaaattgtcaatcagtgctaagggaaatatatatatatatatttttttttttttttttgcagcgttacatttaacaagaagtctgaataatctttgaatcttaaatggcaaccaggctaacaactgtacatgccttttcttttttcttgtctcccttcctttccacagaaataaagtggcctgtatctcctgacaattcaggtgtgactttagtcaaaagtccagtagaaacggtaaagccatcctggcagcagaaaagtcctagagctgttagccaggatattcaagtttgtatctaaacttatgtgaacacacacacacactctctctctctctctctctctctctcatgtgcacacaaaccttgtttaatcagaacctgataccagacccaatataatcctcatgggtgaatctattaaattgtgtttaatatcagtgtcactcacccccaccccaaacctggaaagagcaatctgtatctagaaattggtttgttcatgctgatttaatatataactgctctttctgtgcctcttaggctcataattgtggacacacacagcactgagagaggcgttcttaaagatttctcaaaggagaggaagaagtaaaaagaagatggtgaaatagcttcccaatgataaatcgggttggtagaaaagtcgtcgctttattttcccatttctttccctatgtgtggctaattctaatcactctgaagctcatagcaatgaaaggaatgtttgaagccccttggtcctggctacccttagcaaccacactaaaagggctccagtttagagcacttaacaattatgagcggggccagtccatgaaattagctggtgggatgtttttgccaccaaagtattactgtggggaaaattagatgctgagccaggacacctggtccttcatggttctgtttctctctaggatgccgagtaggtcatattaaccgcactaaaacttggcttcctcatctataaatgtagcaggattctatttgaaaagctactaagtcctttcaattggaaaatgctagaatttgggaatagaatacgttttctttgacctcattttcttctggggacatgtacctaaagccaaatgtgacaattcagttgaagtattagatggcctttctctgggccatagctatgatgtcagggagatgaactagtagggagttttagccttttggggatcatgagtgccccacgagtctgatgaaaagtctggatagcaaaacacacatatatgcctgttgatgtacagcatcacccttgtatgctacaggaagggtggcgggtttccaggggcacatggtcagatcccagttaagaactgccatacaggagatttcaaagccgcacccaagttctagaggtctgtagctccattatgcaactctaggctgtaaaatagttttagcatttcctagctcattaggcacttttagcttccaagatggtctcaggccctcaaatacctattaactctcccagatccttcctgctctacctccccaccctgagttgtgccctggttaacattactgatatctaacaaatatttatcagcacttactatgtgccaggtgtataaattttaaaaattaacatatttaatccttacaaaaattctgtgaaataggtagtattgtcattcccgcattacaagtgataacgctgagacatagagagattcaattatttgcccaaggtcatcaaattagtgggtagtggagatgagtttggaacccagcaatctggctctagagtttgcgctcttaaccactattttcgtttccaaaatacttgggtaatggcgatttacaaacaaaaaaacattccatgaaaattcttcaagttgcctacttacaatttgtgcatatttctgtatgtatgttatatttcaataaaaattttaccttaaaaatctactatatctgttgggaatgcttttggcagcttaaaccagaagggtattcgttatttatttaacaaggaggtgggtggtctcagagttgatttgtcagcttgatggcatcccaatgaccgaagatctttccactttctctcttgcccattctcagtttcctggtagagtctcccctcatggtcacaagatggcaactaagcctccaaccattatatctatacagaaataggtgggcagtgaaggagatctcctcagatacttctctcctctcagtttgcaaagacttccagcaaattttcccaatactctcattcatcagaattaggtaaaatggcgacctttgtaaaagagaaactggaatgtgagtctccgattttttccaacctctatgggctgtgacggagaagggagaaggggtgtggaatgaacattgaatatctcccaacagtgtgtgctacacattccctgtattaaaaaaaggcttccacactgagaaaggcaagagaggaacacaagtgaagggatcaaaggtattcaatcaccatctttctgtagattgaaaaaaaggcctcacactgatcccttcagaataaggtgttgaatatagccgatagtgaaaactatttggaacaggagatttgaaagtctctcccatcaaattggaaggatgagctcttaactaatgacttaatttgaatctttgaaagacgactgtttcattatcttccttaatggagtgtacatcaaatttagtgtgtctccaagacaccagactggatttagccagatggtgcaagttttccaaccttctaataatacttgtgcatttttagcagttaaaatgcttaaaggggatatcattctggtgggaggagaagagcagttggttaagtggtcttgccatcagctttgtgtctggatggcaatgattcttcctctgttcacactatctactcaactccttaaaattaatgtctagggagggaactatttctcagctgctttcgcctatcatcacagtgtctggtttgtgcggttttgtcttagtttaagctcacctggaaagagatgcttagacaaggatttgagtacaaatagtttctttagatgatgaaggaaatactggtagggaagtagggatgggagataggatagggaaggcagcaaataaaatgtgcattatccaattatcactgtggttgactggaacttgatttcactgggaaattctgggagacagtgttaaacacatgcttcagggttcttctacccatgagcgagagagctggggtatttatacacaaactccccagtattatcagaggagggcttcttccaaatggtgttaatttcctagcatttctggcctgccacgtgggcagacaaatctggcttcactggccagagacagccctcaaacaaagaaatgcacgtactggtgtttggaagtggtgagagtcagaggatttaggtttcgtagaattaaaggttagacctcagggggaccttaaacattctaaagtccagagccctctgttattcctccttcccattgtataatcaaagtaactgttgttacttagttagtttacttagttacttagtaaactaagacaggtagaatctcacacctaggcagtggctgggctgcaacaacaacccagttttcccaccttttcatcttagattctttcaaccttgccaatgttattcacaaaccaggaggatatttaaaatattaaaggattattacttagttgaattgtcatgacatttagaaaataatttttctttatgttactagtagtgaatattaataaaatataattgttaaaattaataaacttgttatggaacaaagtacaaataatcaagatcaccctttgcttggcacatatgcctcttgaatgttagatgatctttctgcagctatggataagactggtaacagttctggttccttctactatgcccgttggttattctcagaggttttctgcttaaagtctacccatttagctattaaatacaagacaccatgtgatgtagccagccccatcctctcacaacactcccaatgcttaaaaatgcagtgacgggccgggcgcggtggctcacatctgtaatcccagggttttgggaggccgaggagggcagatcacgagatcaagagattgagaccatcctggacatggtaaaaccccgtctctactaaaaatacaaaaattagctgggcgcggtggtgcatgcctgtagtcccagctaattgggaggctgaggcaggggaattgcttgaacccgggaggcggaggttgcagtgagccaagatcgcgccactgcactccagcctggtgacagagcgagactccatctcaaaaaaaaaaaaaaaaaaaaattcagtgaggaaagaatttgcaaaactctctagtcccacaggtaactgaagaaatcctgcaggtggagggtgtttaggaaaatcttagggaagaagaaagctcagcttcagaaagaccctcatttactctaatcttcttctcatttctctcacccattcctcctattctaagaaagatttaattctgggtcagagatgacaagaaggggagcagaagcaaagtgaatctcataattttatgaaagtgttccgtttgacctctcactgttgggctcaagtgagtctcttgcctcagcttcttgaggagctaagaatacagacatgcaccaccacgcctggccttaagtaggttctgacatgtttatacccaggggttcatggctggattttccaactgaaactcactagaaagaactctcttctgcgcttcccgttccttcttttgtctaaattgtgaaataatatacatactgtaaagcgtacaaatgtcaagtgaacagctcaatgaattttaacaaaatgaacacacccattgaactaccatctaggttagggcatgcattactagcaccaagatgcctactttatatccatcctgtcattaccaccaccccaaaagtaaagagaatcttttgccataaattagttttgcatatttttcaactttctatagatgcaatcacagagcatgcacatttttgtggttggtttcttttgctcaacattaggtatgtgaggtgcattcatggtgttgtgattagcagccatttatttcttttttcatcatcgtatagcattcagttgtatgaatcaactacaatttatctatcctctgatttatttgctgtgccttctgcgtactgaatttcagaaggccattgggatggaatgggatcataatactatttagacatttatacctaaaacattcatcaacagattgccaatggccaagcctagccagcatgtatatggagcttactacgtgttaagtgttgacttaagtacttcataagtgtgaactcatttaactttcatacaacactgttaggaagggtactgttattattcccatttagatgcagaaacttaagcatggattggtaaagtcacttgcctaaggtcacatagctaatttgcagaaggggaagttctggccaatgaaactggcttagatcatgttctctactgtgtccctcgtatacacttctattgccagcattggtttaatgagcaaaccaggggttgtgctgaagtaactgcttgtgtgagaaatgagttagtgtgggcaataaactcatgggtaccttttctttttttttctttatttaaaatttttattttaggttcaggggtacatgtgcaagtttgttatataagtaaactgcatgtcacagggctttggtgtacagataatttcaccacccaggtaataatcataggatctgataggtagttttttgatcctctccctccttccaccctccaccctccgatagaccccagtgtctgctgttcccctctttgtgtccatgtgttcttgttgttgtttagctctcacttataaatgagaacatgcagtatttgcttttctgtccctacattactttgcttaggataatggcctccagctccatccatgttgctgcaaaggacataatctcattcttttttattgcagcatagtattctatggtgtatatgtaccacatttgctttatcctgtctaccgttgatgggcatttaggctgattccatgtctttgctactgtgaatagtgctgcagtgaacatatgtgtatatgtgtctttatggtggaactatttatattcctttgggtaatgggattgctgaatcaaatggtagttctgttttaagttctttgaggaattgtcacactgcttttcacagcggctgagctaatttgcattccttccagccgtgtataagtgttcccttttctctgcaacctcaccagcatcaggtttttctgtttttttttttctttttaataataggaaggaggaagagaaactgcattgcccatagctcatgggttaatagtacaaactgcttggaacagtttttataacttaaaccagaggagacagcaaggaggaagagcctagagctgtggtagccaatagaaatacaacatgaagggagatagagagtaaaaggatggttaccagagatgaggaagggtagtggggggtggtgggggtggtgaggatggttagtgggtacaaaaaatagaaagaataagacctactatttgatagcacaacagggtgactacaatcaataataacttaattgtacatttaaaaataactgagattgtaatcaggttgtttgtaactgaaaggataaatgcttgaggggatggatacctcattctccatgatgtgcttatttcatattgcatgcctactatgtatctacaaaaactgaaaattaaaaatttaaaaacattttaaaaatgcaggtgaatccaagggaagcgagaaacacactaattcttccttttttaaaaaattatactttaagttctggggtacatgtgcagaacgtgcaggtttgttacacaggtatacatgtgccatgttggtttgctgcacccatcaactcctcatttacattaggtatttctcctaatgctatccctcccccagccctctaccccctgactggccccagtgtgtgatgtccccgccccatgtccatgtgttctcattgttcaactcccacttatgagtgagaacatgtggtgtttggttttctgtccttgtgatagtttgctgagaatgatggtttccagcttcatccatgtccctgcaaaggacatgaactcatccttttttatggctgcatagtattccatggtgtatacatgccatattttcttaatctagtctatcattgatggacatttgggttggttccaagtctttgctattgtgaatagtgcctcaataaacatacatgtgcatgtgtctttattgtagaatgatttataatcctttgggtatatgcccagtaatgagattgcagggtcaaatggtatttctagttctaggtccttgaggaatcaccacactgtcttccacaatggctgaactaatttatactcccaccaacagtgtaaaagcattcctatttctccacattatcttcagcatctgttgtttcctgactttttaatgatggccattctaactggcagaaacacaccaattcttgttgcaatcttaaataaaattgcccgtgtacctagaaaaaaaaaagaaatacaacaccagccacatgtgctacatttacattttctagaagccacattttaaaaagtaaaaaagaaaaacaggtaaaatcaattgtaataatatattatatttaacccagtatatccaaaatcttatttcaacatgtgatcaatataggcattattaatggagtgtttcagattcctttttactacatcttagaaacctacaacacatcttatcttagactggccacattccaagtgctcagtagccacatgcgagtggctactgtactggagcagcgtaggtcttaaagccttgctcctcaaactgtggtctgtggaccagcagcagcacatcaaccggaagtttgctagaaatgcagaatctcaggccctgctccaggcttactgaatcaaaacctgtcttttaatgagctccctgggagatttgtttacacatcaaagtttgagaaactggtctattgatcaactgcattagccgggcattttctaatgaatggcagataatagctctctaaccctgaaatcacagccacagggtctctcattaagttcatttgttaacttccttccttctctcctttcctctctctctccctccctcatttccttccttcctttcttgcttccttccctccatttgttcccacattaaaaagaagactttatttcaatcaatactgctgttcctcttgaatgacagtgccaagctattaaattctgcgagctcatcctttgtgaatgaaaggaagtgaattcagccgcagccctatctttctgccattatcctgtattaaatgtccttcaattagtatatgcagcaagtcccctgtaagaccacctgctggtttatgttactcgtgcattaacctcattggttaccaaacatccccattattaagccattgaaagccaggcttgttcacctgccagctctttcgtttccttttctatctcctggatgattttaccagatggaattttggtgagtctctctgtagccatctttttttttatatatatcttgcaagaatcgatttcctcttgcacccctctctttctcttcctttctttttctctgcctcattctttctctccccctacagtgtgttgtctttctgcatttttttaaataccactctgtctccccaggagaaggtaattacttggttgagaacaggttggttatagctgtgtgtgcactcaccaagctggagtctcatcagcgaggctgcttccagcccttgctggttcaagtgatatttggcaagtcatcgctttccaacgctgtccaattgtttctgccagtttgatgaaattgtgaagcaggttgcaatactggcagtttgaaagtggatattgaataggatgttagaaccatatttcgaagctggtttttgaatatcttgctcaccttacctgtttgtttttaaagagcaatgagatataattttagcaatgtgtgtgtatactattaagcttgcagttttagagataatattcaggatgaaggaagacatgctcagccctcaaaaatgtgctttatctgcaagttgacatttcaccgagaagtaatggaaactttccattttgctctacttggtctggtatctcatggtgcctaaagcaggaggaatcaatcaactatggccagtgggccaaatccgcctgcctcctacttttgtgtggccagaaagtcaagaatggcctttacgtttttaaatggttgagagaaaatgaaaggcacatattttgtgacacctaaaaactacatgaaattgacatttcagtgttcataaataaagtttgattggaacacagccataccatttgtttatgtattgcctgtggctgctcttgtgccacaattgcagagttgagaggttacaacagactgtatggcttgcaaagcccacagtgtttattctctgcctttttacagccaaagcttgctgacgcctggtctatagggcactagttcccaactctggctgcaccttggggacctttaaaaaatatagatgcatgagttattcccctaaagatactgatttaattgtttggggtacatcctaggcattggtcatttttaaagctcttcaggtgattctcttttgcagccaatgttgagaaccacataacccaaataagaagacgtaaaactatattcacacatggtgcttttgaggacctaaaaatatttgctcccttacggaacatgaaaatactaatttcattttatttccttgctcttatcaagctgtttctggttcttgcccactggcttagtcctcatttcatttctcttccctatctgagttttttttttttttttttttggcttacatgtttttaagcaccactgaagaaaagtaagattgaatgatggtcactcctaattttaggaccacctctttggggcttcgatgaaggattcacagctcttctgggcagaggaaggctgtggtagctggtgaaagcgtagctgagaaaatccctttctcctttgaccatccagaaacattctactcaccgctcttccatcatgacacccaataattgacttcttatgaaatcttttctgcctgctccaccttctgacctgttagaattgtccccttcagcctttgtactcccattggaacccacacagactttcccctggcagctggggcacttaatggcatttactggcttacatgcctttctatctccactagagtactatttgcttgagggtagggccgtagggccatgtgttattaatgtctgtttcccttgctcccagcatcatgctcattattcagcagatgcttagtacatgttttataatgaaagagggaaggaggaaacgaagccttattttctggggacatcaaggtgcttactaaaatgcttttattattattggaagttgcaggtcagagacataatgtattttggagacagcatcttaacgtaaatcactgaaagaccaaattcctggctttggccgaaagctttggtggaaaacactgacatagcaaggagagtcacaggggtcttcattgtaccatgtcttagtccattcatgctgctatagactgggtggattataaacagcagaaatttattgctcgtagttctggaggctgggaagtccaagatcaagacactaggagatacagtgtctagtgagggcctgcttcctggttcacagatggcacctcttgctgtgttcttaaatgagggaagaggtgacagagctttctgggtctttgaggtcccttttataagggctccccgctccggaacgtattaccttcccaaagccccaccttttaataccatcacattgtggattaggtttcaacatgtcaattttggaagaacacagacattcagactacagcaggcagtatcaaagtaaatggaaccagtcaccacactgaagatcagggtttcagacagggctactccagggaggggatcaccaggggtccagagtggcctcactggaaaatctttgctcaggagaaattcttggcaattacctctagcaaacttagcttgcaatccatcctttggtttgaaccgccttctggactccagcttcagtgccgaatttagcctctctctgagtcttcagttcacctttgtttacttctttattttctctcctctccactggtctataaactatgtgaggggagagaccatgtctacctaattcaccactgtgtatccacacatacgatggtacctaacacatagttgatgtgtgataaataactattgaatgaatgaatgaatctgcaggacccaaatctccagtttccttgatctactgtggaaggtcatgatatttaacatccagaccattccaactgatgagtccaagttccaggtgttcttgacctcaagtctatggataggattcaagggatatatgactgtgaatggaaaaacaaaatacctctttgtcttcactaacctttaactgaaacgtagcttttcttttagtcataaatgtaggcagtaaaccacaataccgttagcaggacctgtgactttgtcaccagcagaatcttttatgtccatgagcaattcagaattatggtagtagttatatctgccactagattttgttatttaacgtgtcaataaagcagaacacacactactatatcaaaaatttgttgaatgaccaaattaatcttaattaacctgaatgaacatattaaaattcgaataacgtcctttccaagtaactggattcctttgtaatcttacgtatttaaaaaacattcttagaaggggcttctaggctttaccacactgccaaaggaatccctggtacaaacaaggttaaaaacccttatttagatgaatagaagaaagttatttagtgctggttatttagtgctggttatatgggtgggctcagtttgtataaaagcatcaagctatacacatattttgaggtatattatacttcaataaaatgtgttttttaattgacctgaaccagtcatggtaatcctgtatcagaaattaatttaagtaagagtatatgtcccaagccaggccaatgaaacatagaggaacttttgccaggggaacgggaaaggagacatggagagagaagccccctcttggtctggactttgccatgtctgcatgtcacatctggagctgctccggccatctcacagaggggtcagagccaactggagcaggaggtgcaacatcatgtgcctggagtctgccctcctctttgatttagaccatgacctccaaaagtattttgtttcttattatattcacttgaaactgcagaacacaaccacactgtgattaagtagtccaagcctgcacatctcatgattgtttctcattaaatgtctggacagccagtggctgggatgtgcacatgctgaatgtaaggcagtggattttttcctccgctctttctctagttcctaggaggcaactagaggcagttgcctggaccagggagaattaccttagcattgagatctagaaatggagcaataccatgagaaactgcttcacttccacagagagtaatccaaataaatatccccctccccagtaaaaacagacttgcacacatacacacagtttctgactgggggcaggtggcaagtgtcacaaatggtcacggagagggtgaacttgggaaagctgggctccaggcccatacatcactgccacagacgcaagacaaactccacctggcagcagccacatggttattgcaagtgcctctgggtgactgttacactgaactctaaagacaagctagagtaaagtgggatcccagctgtggtattgtggacctgtgagtagtgtgagaagggtcatgtatgtttaggattttaaaatatgcaatcaacagagtgcataacactccgccatcctttgccattctgtatgaaactgtctcaatagaaatgcttgccaaatagctctcttgaatcagagtgctatataggaagcattacccccatacacgatttccacaatcacaataacttaggataaaatagtcacacgttgcgagtcagtgctgaggagaataattagaagagaaagatgaaggagtcgaagcagatgtcaaaagggcaatgctctgcctaggggggatattaaggagatggaggcaaagcagatcaggggctcagaactttatttccacaggggcaggagaggggatgtatggaagacaggttcttgatgtgctccagcatggagatctcaagtaagaaccgaatctctgtgaccttgattgagaggcttgaggggactgtgatggagaaatggttctgggtagtcaaattctttctctccatggtagacacacaaatccacttctccacacaggtttaggaaatagtccagggagctagggtctttctttctgaggcgaaacttagaagagagagattagtgagacttggacttggggcaacaaatggtacttgttatcttccttttcagcatcatttctaaattcccttccccctcagctaccacctctactgatcttggtggcttgctggtgataaggcccaaaccctcatttccgaggagtctgagcccaggtaactgttcctttcccaggctgaggttgatgtacatgtctattcacagtcacggttgggcaagggagtaccacagggaacccaagtgaaacaaccgagttccaatgagtccctccctgctccattgtgtaaaagtggccctacctcctcctgctgatcagggtcaaccattcctgcaagatggtgacccctctattggtctgctggacccaaaacacaaagagcacaaaatgtccagggagccgctgtagctgctgtgtcctctgaaaggagacaggtggcagaagtacatccactttggggcatcctaattctacagagcccaaagttgaaaggactaaaagcacaaatttcccccagtggatcactgagaataatggcaagtgggaccacccctgcttccccaacctggttcacagatccatgtgttcttcctgtggaggatacaatgccatatagaggtctctgatacagcatatgtattgaattctggatgatggcactctatcttcgcagagcctttcctctaaggtggcacttctgttgtaccctcaacaggcaattccacaaccagtggatcccatgatcccggaccactccaccacttcctgtgctacaaaatgaagcatcctggtcagatgctatgttatgtgggattatatccttgtaaatcaggcactttgtaagtccctgggtagtaaacctggctcaggctctgcaggcagaaaaggcgaacccacatttggaatgagtatctattcctgagggaatgaattgcagtattttccaagatgggagagatccaacaaagtcaactgctaccaagtggccagtctcctaaaggaaaagtaccatattgaaggctcagcattgatctatattgctaacaggtggcagcaataggttcttcctgggcccaagtgtgacctccatctctaccaccatggctactccattgtttccattgtaccaaatctggtggcccgcgacaaaggccgattgatgccatctggctggtttattttgtctacttgattgttcagtgcctcattcatggaggatggatgctttctggtggggattaacatgagaatcctagatctttaaacttcttactattccatatgtccagctacctgccagaagtagtcaccaggctcacccaaacacaatggggccaagaaaagcaatccaatttttatgcccataagatgagagcaggaaatatttggagaatagcaataatggctaccatagttcttgtctgttatattctgttagaaaagtctcagagcatgctctttctctaatgttctacagaattttagtgaaagcaaaagtttacttacagcttgcttgctttctagaatccaagcaatgtttctttagggctgggttagagacagtatagctgttgggtttcactcagaaaattattcccttatgctttattactggtaagagcatgttattcctggccttttttagttctgttaggggggatttttttttttttctaagcagctgttcaatactcatgtaaacaggcttcctgtaggcccaccaaacccgttgctggtcatgcccatacacatttgagtcccactaagatgcaagtctgctcccactccatacttatattactatttatattttttgggccttgactgatcctctccccagttacagtatatgctgcttgaatgctgagcctatgtctccttcctctttatagccccagctcctaggatgatatcctatccacataaaatgctttgtaatgtttgtcactggtgatgaagtgattccagaaagcaaacaaaaagggttttatggcaaagatagccacccatgcaaataatgtaaggcaaacagttctcaaaggataaacaggacctagaatgtcttttaccctgggcatttgctgagccaatatgtgtgctccgacctctagcaaatggccctctgcgcgtgagcccagcgagttggagggcctggttgacaatttatgtggctaatgttcagagcattgcagctcctcaggaaggctttattgaatctgaatcccagaaaacaggacaagcttagccaagtctatgtcaattaaaacagtgtaaccattttattttatgtgcaagacctcgagtagcttaaggcaacattttgaagtcaaaaaagtcggtcttcaggacccttgctttctatttctattcccttctccattttaactttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccagcctccattttaacttttatcccctacccagaagcaaaaacagaatgccttctatttggggaaaccaagaaattgttttgattttttgttttatgacccaaacctatatattactggctgctgtgacattatttctccctgcacgctcatcattcatagctacaggggtgaaaatattccaaaatagtatgtaatgtctgttatgcatttggatgcataaattttggttgtcaagatggtgatttaatagaaacttataggttcattgtagaatattcttaatgtctagtgttttaaaggacagcttttgtgtttgtgtttttcatttctctcttcttggaaatattacttttttgtaatatagtcctactttactatgctctgggtccaacaaattttggtaacaggcttaaagtaaattaaggaaaaagcatttattaagagtcaggatgtaaagtatcttgattgcatattcataatgtcaacaataaacccaaagtctcaggtcctgtgacctcaggcatgtaagttgaagatgggagttcacattttaacaaattatttctttgggattataaatcaaagacactggattaaccccctgagaattcaggtttatacctatctgtattattttgagtatgtttctagtatgttttgaaattttagtgctctttaaagtgtagattctctctctctccctctctctctcacacacacacagatacaaacaaacacacacacacattcttgtcctcatcctcactttcattctcattctcactgttgtttaacttgtttgatgttactgatcttctccactaatttcctcactggttttggcaggaatttctttgcaaagaaagctaaacactcctcttcactataagttaactttggccgtgtaagattacctggaagggaaatgaacgtgttctataggtgtcactaaaaataaatggtctctatctgtttttaggaccattgtaatgcattcaagctaccaacatgaaagcgcaaatttttcatcctcttgtaagtggtccagaatgagagtcaggatataaactgtaagatatttttcaagtagtttgaacaattcctcactgggaatttaaattgtaaatgtctttactacattctcttgaaagttggggtaggaatgagttacagtaaggaacagctgacatttctgtgcaatgggcaacataacagcgattttactgcgttgtttttagtaattcaccttcaggaactaggtcagtcttacctgcccaggctgcagtaaaggagggaaatcattcaagaatgtcactagaaattttgctgtctgtgtctcttctcactgatagacatctcagactttggaaaatatcaccaatgcaagacaatcagaatattacagaataatatggttgggacagagagataccattgaacagtgctggccaatggaaatataatgcaagccacattataatgcaatttacaatttacaataattgcacatataatgcaatttacaattttccagtagccacattctaaaaagtggaaaaaaacaggggaagcaaattttaaaagcatatattatttaatgcaatatgtccaagacattctcatttcacatgtaatcaacataaacaacattaatgagatagtttatattctttttggtattaattcttcaagatatgatatgtattgtgcacttacggccatctcaattcatactagccacatttcaagcattcaatagcacacgtggctagttactagcatattggacagagcaagcatggagaatatcctactcaatacctctctctgacaaataaggacccaacattcagaagagttaagccatttgctgcaatcaaactgctgtgtcagaaagcaagactagaagccagatctttaaattacttcttaaggctacttttcactactttgagaatttttctatttcttttttttccctgaaatcttattgacagcttaccccaaatctcaattttattttgcttctgcagttttcattaagaaaagccatcttaaaacaggagcaagaagagcaaagacaaagtcttatgtggggcttcagcagtattctggtacaaggccttcaactacttaagaataaagtgtagaaatattaagcaatatttttaaagcccctaattgttttgaataatttaaaatgtcaaagcctgggcaagttatatctggggtcactgaaagaacatgcagatgagataataggaccacaattggttaccaggaaaataatggagaagggaagagatgctggagaattggcatgtctggattttccgacttgaaaaggccatggtactagcagcaaacatagaacttactaggtgctagattctggtcctgcgtgttttacatatgttgactggttgattcttcataacaactttataagatatgaactaaaactctcctcacttttcagatgagggaacagaggcacagagaagttaagaacttgcctaaagatatatagttagtaggtggtgaagccaggatttgagctaggtagtctgactctggaatctgactttctgaattggcatggcattcagttgctcacaggttaaagatttcagtatctgcctagtttgctgcccttccatcctctcttcctacgactgggaataatcttatgttcattttcacaatagtgaaaccttccagtaatgagtaaaaacaccatagttcaggccattgagctgggcattggtccttggaaaaattataagtgtattactaactagttgatttggaagcacttgaaatggaaagtgatgattattaagaaatccttctaaaaccaaactcaatccccctttccctttcattggatactgttaataaaattgtcagtaagaagaatgcttagatattgtgtatctggatctcaacaaggtatttgatagggctattatgacattttgtggatgagaagccaagaatgtggtctgagtgatagaataggtgtatgaattctgcttgatcttgaatgtcatctttgagggagagcttcaatactgttgtgaggaccttctccttaaccctttcctattctactttttctcaaaggctataataagcacttatgatgaaatctcagcaagtttgtaggagatgcaggatagagatgagtagattcagtggccaatggcagactcagaattcagagggttcccagcaagctataatgaacagttaaaatgaacaagcttaaatgcaataaggatgcatgtaaatgcatgtacttttgtttaaaaattaaattctgcgagagcagtatgaaagagacatagattaacattagtgtagtggtggttggggggagtcttaggacctttaatttattgtaaactcgtcatgagccaaaagtgtgtatggctgccaagtgttgaatgtgatcttggactacattaattacagtataatgagaaggctaattccattgtacttggtacctaccagactctgtctgggttattgtacttagaccatggcaggctgacaagctgcaatggatctgagacaggcagctagagtggaaaaagaatctggaaccaatgatgtgttggagctggctggtacctgcttgctagagattgctaaatattgaggaattttgtgagctcgttgttaaacctttggtagcttgaaatgggccatggtgaaagtatttataccattgtaattggcaaatgctgcaaatcaagactttttgtttctagagagtgagtttgtcaggaaacctccatcagtcacctaatatggaacattattcaggtcagagagtgtattattgaattgcattcaataaaaacaacaaaaacaaaaataaaacaaaaacttgaggtggtgggtgggagggaggatgatgaggacttcagcattaactttaaatacttgaaaagtttacatttttgctgtcagcaaatgagagtaatgcttctcaaacactcccatctttacactaaggacagcagagcctgagctctcacatctttcccgccatccagaggtgtggccccaaaccaccaattaatagtgagaaatttctctcaagtttctcatattatctttaaaagttatgtaaactttacattttattccacaatggattcatgtctctgtgaatttacaaacaatggattaaataggtgcttcttaaacttcgatgcatatgaatcccctgggtatctagttaaaatgcaggtttcagttcaggaggtcttggggagagattgagattctgaatttctaggaagcctccaggcacctggataaaggtctatgcacagtttgaatagccagggctgaaattgtgaactaacctatttacttgctttccctctctcctcccatcttccagtaaattttacaccctgggatgatgtgccatgcttaatctgtggctgcataccccataagctcttctctttgctcatctcctacagagacacaaccctctggggatgtatacatgtacctcgaaaagcttggagttacaaccttaatgacttgtatttcattatttgtcatcttgcagaattcctttccactgaacagcacttcagccttataccttctgccgatgccgagtaccattacaaaaaatagtggagaaaattcattcttttaccgattatggggaaattgtcaaggatgtcattcactacatgactttctgttctctacttgaggattcagaggaattgattctcaagtttgctttccagaaattgcttcttcagaacaatttactctttttaatcttaccaaatatttgaaatcttatagttgattgcgttttcttttttcattcaacattcattcaatgcatactaatactggcacctgctaagtgccagtcactagtctaggtcccggggaacacagcagggaacaaaacagacacatatacttgctctcatggagcctacatttcagtgtagaaaacacactctgattgttaggaaatacagagccatatttcaggccaccttcaacaactgtaaatgaccatataaaatacatttctggtttgaatatggctcctggctgtatggttctctaaccctcatcatctctttacctgattctctctactttttctttttctctttttggctactgtgtacattttatttttgcaaaatgcctcaaacccttcatagaatgaggcagaatataaataaaccactaattatgtgcagcaaagccaatgcaatgcaagaaagttatagagaattgcattttattctaatacacaaatagtctaatatcctgacatgaaatggctcatcttataatctagtgacttttctgaccttagaattggctgttcaccttgtctgtggaattctgacatggtgcttctgccatgaagtggtttctactggataatatctcaggtggcttttagtagtcttgatagtatggaaattccatgatttcaattattccacacatcacaacggctcctattctccccacaagtccccagacacaatatctattggagaagatgaattctttgggaagatggtaactctggagaatcccaagaggcaggggaggggagacgggtggagagggagagggttttctgccagaaaagcagctcagggctcaaatcctccacctggtccatgttttgtgacactcactaaaatctaaacttctgcctttttttctaacttgtcttgatccaattcatggttttcttcagatgaataaaatattcctgtatttatagtagatgctgtaaaccagccagccgtgatattttttatatcataagcagctgctctctgagccgacactgagtaaaaaaggccgatttgtatttttacagccagacatgaaaccagctttcaataatttgggaagcacatgccaccactttgatcctcagggtggtaatttttaaatgagcctctaaagattgcagatactccaattaatataatcctgaaaggtagccccattgtaaccacttactcaaaaacaggaaattttaaagaattaattgattttaacttcaatatgaaatattggcacttgtgatgatactactctgtgaataggtagaggcagcatttatgacctttttaactacattccattcactgaaaaatgacaactatgctaaagaaatactttcctccttgctgctggcttctcccaatgagagcttttagtaaagggcatagaaagtcctgccaataaataacaaaaatttactatccccaccatcattttacagtcttgccctccccacaagaggaacacagaaagcagaatagatgaaatcaacctgctttgctcagcaccaaggacatattattactcaaactgggcaactaagggagagattagtctaggaagaatacacagacggaaaatggtgttgccccagaaacatttcttgttttttgttgttgttgttccagtttcccaccactgatagctgtctgctctgatttatctccaatgttacagaaatcagaattttcctcacctttcgaggacactgaaagatagaaacccctttgcgtcaaaagccatctagaaggaaccatgtctgcattccttttgtgggatttaacacccctctctgtataagagagactaggatgctttagaaaatgcatcttcagactccttgaattgaggaaggaagagagagccagaaagagcttaactggaatgaaaagcattttcctggactctgctctcctgaattaatcagctccagcataggcagcttaaagagcttgttggggaaaaatttctcgctcatatgtctatttctagccaggctgtatacagatgagtgctttctagcctttggtctggggccattgctatccaaatcaaaacaactgtttgccatttctatagagaactttaatgatctgaaaggaaatcacaggatgtagaaaaagacccagatttctctccattagtggtttcaagggctcttggtatagtgattcttgaaattacaattatagttcacgaagtttctcagacaaagcccagctattagatttggtttaaggaaagaacagggagagctctgggctttatctaatagaaccccagctttacagtccttgtctaagtctttaaggaaaataacttacaccagggagtaaaaagatatatttccttcttagtaagtaggcctttagaacctagcacaagttcttccccccgcccccattattttgggcttaatacctatattcaggctattattttcatagttaatcccttgctgctctaaatacattttttattataccactgatttcaataacattactctgcttccacttacagtgatggcatacccaaactctccccaaacaagaaatgcataggagcaaacgaaaagcattgatgataattgagtttctgcaatggattgccattgggctagccattttcgccagtgcaattaaagtctctacgcatgtgctataagattagtataattctctccattttttagatgaagaaactgaggctctaggagattcacccaagcccccaagtttctacagtttgaactcaggtagcctgactttagaacccgtgctcttttctgatagacaaaattgcctcttgttcaggattgaagatacaatctacatttcgtagatggcaatgtaaaggctaagatttcagactttctcagactcccacagtgatccttgccaggttggtattcctggaagtctgtttacaataccatagcactcagcacagtcactcaagacagatcatctggctgaatcagagtggtgcctgggcagcacacgggactctgtaagagaagatcttacaagttaccttatacttaatgtaaagaatagctttccttgggaatggtagaagcctgcccacaataatattaacccacttggttatgttatactgtcttactggcagcctgcacccattcatctttactatttttactattttgttgcaccaagtgattactgagttttcctatattcatgacagcaacgtggaattctgatttcccacttacgctacacaggcataccacccaatgaagataactgaactttcttcaagaactgtatatttctacaccattcctgggacccagcatggagaatgaatatacacccagaaagcctcaaaagagatgttccttgatacttccaaccactcagagttagcagaatgggatcaaagatcccttttcctttccttgtacaaatgcactctgcacatctgcatctgagtaggagccccggatttctacataagtcatgggaagtcaggtcagggcagaagggcattgtggcggaggctaacagctggccaccaaaatccattgtccccttcttccacagtaataaagttgttgccagacacatcgaaggcctctgtcatgttcttacatttgagcccctctgtacagctacagtgtatttaaacataattgcctggcgacacgtttgctagtattgtttgcagttatttgtgaccatgtgactatgctctagaccagtggttctaaaaacatcagcatcacctgagagcttgttagatatacaaattcccatattcagtgaatcagaaactctgggggcagagctcacagtatgcattttaacaagacctgcagggtattctgatgcatgttgaggttcctgaaaataaaacgtgaatagaaataatgtgtggtccttccatgcctaggcctaaagacattgagtaggcctcttccatgctcttgtcctgcttccttcaggccagagccagataaggcttcaacctcggatcaaccatgctgatggagacagtgctttagggcagaggttttatgccagtttgatgaagctaaagagtctcagatttaagtttcgaatgcatacagtaaaatatataagattatttttaaaaaccatttgtattggcctggtgcagtggctgacacctgtaatcccagcagtttgggaggccaagacaggcagatcacttgaggtcaggagtttgagactagcctggccaacatggtgaaatcccgtctgtactaaaaatacaaaaaattagctgggtgtggtggcatgcaccagtaatcccagctacttgggaggctgaggtgggagaatcacttaaactcaggaggtggaggttccagtgagctgagattgtgctactgcactccagcctgggcaacagagtgagaccctgtctcaaaaatgaaaacaaaaacaaataaaccacaaatctttgaaacagcactatatgtacagttttagtaatgcattaacaagatctggtggtaggtataatgacttacataaatttgagatatctgcaaaaactgtaatataatatggaaaatatctgtgatttctctttttttttcaattcaaatgaacatttattgtctgtgatttctattggtgacaaagttccaggtactcctactataggttgttgtctacatttctaatgtaaggaaatgctaaatttcaattagagatttgtggtaggctgaataatagcccccaaagacatccatgtgtgaatcccagaacctgtgactgttaccttacatggcaaaagggactttacagcagaggtgattaagttaaggattttgagatgggaaaattatcctggattattcaggtggggcctaaatgttatcacaagtgtccttataagaggaagacagagggagattggataatagatgaggataaggcaatgtaatgatggatgctatgttgccagttttgaagatggaagaagggtcacaagccaaggaatgcaaggaagactccagaaggaggaaaaggcagggaaattgattaactgccagagcttccagaaggaacacagccttgccaataccttgactttatcccagtgaaactgatttaagacttccgacctccaaaactataagggaatagatctgtgttatttaaagccattaagtttgtggccattcgtcacagcagcaatgggaaatgcatataaggttagttaaaataatggtgatttttttttccatcagtgttcatgaacctcttgagttctatccatgaaccctaggttaagaattcttaccctaaggttttggggagctacaaagtggaaggaacctgggtccttgaatgactccatgaggcagtgctgcctatgaatatagaacccttactttagaccaatactaagagaaaaaaaaacgtctttgattctttaagccactgaatttttggaggctctttgtaatagcaccatagcttcccttaactattatggttagtaggtgatgcttcaagagggtacagggaatagatataagggaatcgtatatggacaggaagaagaatacaaagcacctcagcccatctgactaaggagcaaacagtactgatgagtggtaagggctggaaacagacccagcaaggtcaggaagctggggctgcacatcacagggcagggtgagaaaggggtggagtcatggaaggtggggcagccagggccccagcagcatgaatgactgaggccctctttgtgtttcagatttcatgtctgagggtcattctcagctcactgaatgccctggagtattcagccaataggacctggacttctctagcagccatgcaaaagagcttggtttggggtttagtgcatgtcttgatggtaccttgcagacacttgggctcttgttcccccagccatgaatctctagccttgttctccaactctgagacccaaatgggctcctctagtttgaacaatcttctggtctcccttccctgcttcttggacctcaaaattcaactttcctcaccttgctgtctttagttcccctaaggtgaaaatttccaacttcaacctagcctctcacctcctgtttctttagaaacccacccccaagctgagcatgcctcagcctcatctggaatggataaggcttccaaaagacatcttttcatcatggttctgccttgaaataaagaaatgaacacttctcaagagtattacttgaagataaatttatcttcatttattatatatagacatcagcagttgaagtcaatcactaagtgatgaaaaagtatgagtgtacatgtgcacagagtactcatatttcttaaatctttctgcacatgttaagaggtgttaaggaggagagaagttaggtgggtagtttaaaccctacctttacattgttttaatgtatatataatgattttccttgtacagttccttatatttatcaataaaacccggtaatcccgtaataaagcagagtcgctgaagaatgtctgtgatgaaattttggagatgttaacagctgatgaaaattgaaaaaaatgaagtaataagaacaaaattttcttctgaaaatgccatctggagtagccattaaataatcataactcctcacattggtgggaaatttggtcagaccgaagtaaatgtaagcgcaacaacaagaaagttcaaataattagacaaatataaagaactaatgaaaagaatgtcttttcttaattgtacattttgatataaaaatatctaaattaactctggggataggaatatataaattattattaaaatatgactataacttaattacagttttgtttcatttagttcctcaaatgcattcctggaaacttaggcaaaaatctatcagtttttttcttggttataattataattttggagcttccatgaatacatgaaagtcaattgcaagaaatttttaaaagataccaattataatggtaacaaaactatataaggtacctaggaataaatctaacatgtacaataattctatgaaaaaaattgtaaaactattgaaagatggtaaagaaaaactaaatcagtcaagtctatgaacatactatgttcacaggtaggaggatttaataggataaatagtctactcttccccagattgaactataaactgaatacaattgaatacaatttcaacaagatggatcttggcatactgcttccaaaatatacatgaagaataatgctgcagcctatctaagatgctcctaaagaagagaaaccaagtggaggaattggctcgcccaaataccatgacttattatataactgtgtataataatgtagaggttcattttggatagtgtatggtgaggtggggattcgtttccattctttcccctagagacagactattacctcagtatcatatattgaatagttcattttatcttcttaatttgcaatatgcatgtatctgtgtctgtggtctccttcctgttcccttgtttagtccctatgctaatctcggaagtaatcccatcacttttgccatactctattggttagaagcacatcactaggtccagtccacattaaagggaaggggataacacaagagcgtgaatattaggaagtgggaatcactggaggtcatcttagaagtcagcctgctacaatatatgtcagcccaataggaaattatacaaaaggcattaacaaatatttcacaagggaaacacaaaagacttataaacagttgaaatgctgctcaactccattaattaattaatttctaataccacagtggatatcatttcatgcccaccaaaacagaaaaattcaaaaatgactgtattagttgttgattatttccatatgttggagcaatgctaactagtacatatttttcataagtgtgcaaattggtacaacaaaactttggaaaagaatttggcattacctaataaagttaaaatgcagaaacctttagcctgataatttaacttcaagcatacactctaaagaaaccgttgtgcatgtgccctgggagaaatgtacaacaacatacatagcaacctaatttgtaatagaccaataccacaaagccaaatgtgcagcaccagtaaaatggataaattgtgacatagtcatacaatagaataccatctagtagctaaagtgaataaactacagctatacacatgaacatgaggaacattaaaaaaaaaaccatattattggctgggtgcgtgcggtaactcacatttgtaatcccagcactttgggaggctgaagtgggcggatggcttgaggtcaggagttggagaccagcttggccaacatgacaaaaccctgtctctactaaaaaaatacaaaaattagctgggtgtggtggtggtgcacctgtggtctcagctacttgggaggctgaggcatgagaatggcttgaacccaggaggcggaggttgcagtgagctgagatcatgccactattctccagcctgggtgagagagtgagatatcatctcaaaaaaaaaaaaagaaaacaaaaaccaaaaaacaaaaaacccccaaaacccaccatactactgagtgatataaacaattcatagagattagcatacagtatgatgttatttatatgaagttcaagaacaaggaaagccaaataatttgcgtatttatatatctatatctatatcaatatcaagaaagttattaacaaaagcaggataatgaagtttcaaagctgttgggcaatgagtacttaaatgtttattattattattattatttcagcagtgagcacacaatacattatcttatatatggtgtttttgtgttaaaaagtatagggaaaaataacaatagctactgttttttgagcatccctctgtgctagccaccttgcaggtgctctctttgaaggaatgcatcctgagcttttttttttttaatgctccacctctcattttctgtttattggtttttactttcaggagtcctaacctaaaataaaatagaacatactgtgcttaaagcaaggggggaatcatgtaacaataaaaccagtgaagaaaattctaatgctcaggtaaggtaagtagaattttacctttatacacaagccagaaattataaccatttaatctacccacagaaccctctgggccaaaagtagccaaatggacaatcagactgtagcaggatttcttaacctcagtactattgacatttggggccagatcattatttgctatgcagctgtcctgtgcatcgcaggaggagatgcgtagctctcctccccaaagttgtgacaaccaaaaatacttcgtacactgtcaagtgttccctggggaggcaagattgcccctgtttgagacccactgaaccagatggtcttggcacactcagtggaagtacacacatagggaaactatcaaatgtctatcttatatttccttggtatttctgtcattcatctattcccttgacatttattgagacacattcttaagaactaagtgttaactttaacagttaaatgatcacttcaggtttcttgaatactaatcacccggcatcagctcggaaataatccaacagtttataatcacaagtctgcatttctttattgtcaagatcttttcaaaataaatagaagactagatagacctcaacaggattcaagtatgcattagtgtccacttgtaggtttgagctgaccttaaagggggccaattacgccctccacactcaaggctaatggagtttttttgaagttttgttgggtttagcatatgaggagcttccagctatgtaaactggatagctgcttaaattgattaaatcataacctgagctaagtggatatgctgatagcaagactgacctgtattaaaaatttagggaaaggacacttgaaaatgttaatgcacacacttatatgtatgcatagcttttttttctacttacataggagaaaggttttcagcctctctgtacatggtgaatgtaggctgcagacttcatgaaaccctttggatgttcattttctttgcttagtcatttaaaagactcttctctagctgtgcatgatttgctctttctctgtccttgctcatatttttaaattgtgcatttacaaggaataaaaagaaactcctaagttgcagtgtaactgtgcgcaaggagtgtattttggtccctgctgctgtgtcagaggctcaaagaagggatgctgttgccatagagacagaaatgttgagctggctctatcacctttgccctgctatttagaatcatatgcacagcaaagctctggcagacacagggctttctctggtaggtcaaccacctcctccctttttctcttttaaaaacatcaacttggcagattaatgccattttcatttatgactgttataaaacataacgtaaatatcctcttgcacagaatgaatgggcagctctttgtgtcatctcattccagcatgaaactgaaattccttgagagtttgccaaaaccagttcccctaatgggttctaccctctatcttggctttctaagagtaccagagcagtgggtagagaacagagagaaaccatggacattataagatgaggcaaaagtgatagaaaggaagttaattgcaggcttttaaaatgttgtttaaacaaacccctctgtgcttgggatacaggctcttctcatacactcctggtgaatgagtgggcccatgttggctttctgaaggcaattcagcaatacatatcaaaagccttaaaaatgcctcttggcccatcaattacaattctagcgattaattataagagcacataagtgattgtaaataaatattttaccacagttttatttacgagagtggaaaactggaaacatccagtttcagaaacatgctcacaaaagcggattggttaaataaattctagtacactacacaatggaatactaggcaactgtattaaataacagtgtagaaggttatttattaacttggaaatgtattcaagtgatactatttaatttaaaaaagtttacaaatcactaagtgcattagtattccatttaagaaaaataattattgaaatacacacatatacacatggaaaactgaaaggttatataccaaattttggttctttgagtgttattttaacttattctttttacttctcaattttataagttttacagtgaccctctattacttgtataatttaaaagggtcaattactaaaaaaaattaattcgtatgcatatgaaaaacattctttaacttaaaaagtcttagaagtgtttcttagagaaagggaatttctactcaatgtcctcagaatttcaagaccaagtcattaccttctgctctcaaatggatccttttcagaattttggggacacttttttaggccccacaaaacacagtcagttaagtccagctaaaagcattgaacttactgaatttttgagctactctaaactggtgtccagaatagcctccaagaaagcagggctcactctatccatcacctctgccagaactctcggctacccaggtaacgacatccacagaggggaggcaccagctgctgctgagagctgagatgaggtgcagatgaggggatttaatagtcccatctctgtcctctcagaatccttccactggggatgcagggatgggggtgggggaataaaccttgagcaaaccataaataaacttgctgctaggatgtgattgcaactctccatgctctctcgctttctatctttctctctctctctttccaattctctctctctcacacacacagacatacacaaatttgtcattaccaatgaacccttttttcaatatgacatggaggtgagtattcctacatcacctgtacttatttcctttcctaatggagaaatttttgtgagtccaaaataatgtgcagaagcattggatgcgaacaattgagacacgaccacagttgctcgtcactctagtgacaccttcccctccaactatcaatttcctcaacacgatcacagcaaacaagataaacacttgggtcactacaaagcataagaccaccttaacaatatttccatggacccactgtaaaacatgaacaccatattaactgtggagttcttgaaactgcaggatgggaggagtagccctttccatcgccccgtatccccagccctggcagctctggaggggtgtggcctatattatttaacaagcagtgaagctaaggtctccaagctcctctggcttgccctaaaacttcactctcaagttttcattcactgactgccctcctgtagccggacaggcaaagcaaatcaaagacaaaatgcctccccaagtttccattagctggagctttttgaatagcaacccttaaccacaagaacaacatctacacaggctttggtgaaaaacaatattggttaaaagaataagatggaatggcctggaataaagcaccaaaacataggacagaaatgatttgtctagactaaatacaaggcattgcttttcattttctcaatattgcttttgatacggtatgcaatagactaaatgtgctcctccacgaaattcacatgtgaaactctaacctccaacgtgatggtattaagaggtggggcctttgggaggtgatttggtcatgagggtggagtttctggtctgcaaccctgaagaaagccctcaccagaacctgatcatgctggcaccctgatctcagatttctagcctccagaactgggagacataaatttctgttgtttgtaagccccccattgtatggcactttgttatagcagcctgaaccaagacatggtacttaaaaaatgtcagaatgtatttttacttcagtttagttcaacaaaaatttactgatcctctctgtacctcactattttcttctgtaaaatgagaacaggaatagaaactatccctggtgttgttcttaggattagatgaatcagtatgtgtaaagcatctaaaagtgcctggcacaaggtggatgctcaataattattaccattttttttatcattactgagcatccctcactaccagacacttactgagcattttatgtgaaatagttggatcttttttattgcactacatcattccattgtatgaacactctttatccattctcctgtcaatagacaggtgagtttcttcgtagtttttggctattgttaattaagctgctatgaacctttttgtagtcatcctttgcaggatatgtgcacccatttctcttccatttctcttgcgtacatacctggaagtggaattgatagatcactgttcagctttctagaggctgtcaaacagtttccaatgtattgacaatacttatctgttaatgatctactttgtgctaagcacggaaccaccagctgggttctgaagctatacgataaacaagacatagtcccttcccctgtggagttagaaatgctacccccctaagtagcactttaaatatcttggctcttactgttccctttttatctttcaacagaaggacaggagtgctacgtacagacaaaaaggttgaaatgcaaaaaaatgtaagtgacaggctcatgatctctagaatcataaggcaaattagcagtgaagctagaactagcagaacaacaacaacaacacaaagaaacaaacacgcacacattccactcttttttctgagcaactaggtcataaagcttcaaagggaggccatcctcagatatatgcagtagtgggcagttcatgcccctgcctgcttttattaggccaacgtgcagtacactaggtgagcatagctgagacactggggagctcctgaaacctttctctatgctctggaaaaatccagcattgagctacctgagctagtctttagtttggctctgtgcgaaagcaaacaagaggaatatcagtagctacctttccctctgcataaggaaactggacatcttagtgaaaaaaaaaaaaaaagacacatttgggcaaccacagttaaatgttttatttggcacagagagacacattctaattcaacatagggctgaactgatatgaacacttttgggtggaagggagataccagggttactcaaccttggcactattgacctttggagctggatgactctttgttgtggaattgttccgaacactgtagaatgctcagcagcatccctggctcccacccatagatgccagcagcacccaattgagacaaccaaaatgtcttgagacattgccaaatgtgtatgggggagcaaaactgaccctggttgaatcactgggatacacttatgttaagaatgtgggacagttgagctttcctatttcctaacattctaaatcttgcaggtgggtcctattgtaagggagaagggccgacatttaatatcaaggaactctgatactccatagacaagtgtcaagaacacttagtgttttacttccttaagggaaataactagaatattaatacagaataataaacagaaaaccccatttcaactattggaaaatctgagttatgtcatttttcaatatgattttacttcgaatgcagcagggtgagcttttcagaaacttctttgctgaataatgatttgcaattttgtatcagttgcgtattaatagatattatgagagtgctttaagaagaaaaactacttcttctctaaatgctttgtttttgttgatgttattgacacttgtgattttccctatctctaaataaaggtttaggtaaacagatgttaaatttttgtttggatcttgcctaattatggtccagcaaggccaggggagttattgtttttcaaagaaggatcttcttttccataacgataaaggtttaacaatgtatatatctctcattcattcattcattcacttaaaaaaaggtaattattcagcctgagcaacaaggcaaaaccccgcctttactacaggcctgtgccaccataagccaggcatggtggcacatgcctatagtcctagctgctctggaggctgaggtgggaggttggcttgagccttggaggtcaagactacagtgagctgtgattgcaccactgcactccagcctgggcaacagagtgagactctgtctcagaaaaaggtaattattgagcatctactagttgctctgttatggggatataagtgtgcacaagacaggcacagagtgcatgctggtggtagtgggtggaaagcacactatggagcaccagtggtggtatattcttagttctagctttgccagtggccacctctcagacttttggagggccacttcatctttctggaaccatgtattaagtgagataggtggattaactaaaatggcaaataggtttcacctctagtgccaacacatcaattgctattggctgcccagagcacttgattatgaggttctatcttcatttaatggccacgagggctatcactgattactgatgtctggcataggcacactgtggaaactgagggcaatccgcatgaatttgccatccctggacttctaaggcttcagattctgtgatttgcaaagactctgccctttctatttcagtatagtttggtgtaggtgagcaaggttatttaagtttcttactttggaaacaggccatattctccctttgccctatcctccacttctaattttcttgttctggtcctagagaagaactgcaaattaattccataataccattcccccaaaggttagtttgcaatattttctgacatcctccttcatctttgaaaagatcaaataaggcaaaacttgacctcccttcattcagggcctttttaggtaaatgatttccccgtgtagtgagagatgactgttttcttaattttgaatagatgaaaataagcaccaatcaacaaacctttggctaggaggaaaaaatccctttaactcacattttgcttcaattacattgaggacaaaggagcacatcacaccctgtgcatgaatagatgcttcattattcaaaacaagcatcaaagagcatttcgtcccctatagaaaatacgcaatcactgtttaattcaatggtaggatgcaaatttaaattcccataagggaaaggctgttaatgccatttaaattggttgtaaattacagataatacgctcgagacccccgaatacagattagtggagtattgctttaggaattcatttctactttgaacttattgtgtatttatctatgaaaaataaagccatgaagccttgtttacagctacattttattgcctatctttttttttttatttctgaagcaaatatttcacttttaaatgccatggagatggttcagtgtagtacaaggaaacgccatgatgttaaacagattagtcttagaggccactcttcattaaaaacaaacaaacgaacaaacaaacaaaccgaagagagaggcagtacgatggcatttgataaaaatatcacatagctgacttttctatctttttacctcatttcttttggtgttcctgccatttaaaaagcccacggtcgcaagacaattatgcttttcagaaattagaggctgtgattatctcttgctgctaaagtatgtcaaccacttagaggttgtttctcattttcacagattaactaatcatgagtgggatgcctgatgggtgagtctttgttggaagaattattccttaaaaacaagggcctttcagaagaagaacgtgttagataaaaatggacacttttcaacaaaggtttctgagctcccagcttgaagaatagcaatttccctcccagctcagagaagtaaaaactattccttctttgatgtggtttcatgtctcacgtaggaaatagggttatgtgggtgataaaaataaatcagctctgaggctcatgttttcttctctggcagcctagggggtgtgtttttattttgtgagtgtgaaactgaaaggtatataaaaaaagttgccattgatatatacacacacaatgaagccaagctatggaacaatggaggaatgcctaattcattatgccagaaaatggatcattaccatcaataccacatggagttaatcatttccaaagagctatagtaccaggatatccataacactgcacctaaatggaataatgttttattttttctttgatctgtcacaggtacttcaatctttgccaggactctagtgacactataaacatttcattacattgttcctatgaattacacaaaccttgtgatagctcttgaagttaattgaattttttttaaattcccagtattatcttgtttgtcattttgtaatgctttataaaataacatggaacctgaccctccttttcttttcctggctatttgcatttaggttaaatgggagttttttctttacaactaaggataaggatgaaaacagctagttgaaacccaagagtaaggtaatctgttcacgttaagaaactaacaaaatgggggtagcaagcgtgggaggggcgaattcatggtttaggatctttctgctttctttgataggatttgggttagaataatcttgatgcaaataaaaagtggatgaggagtctttgaatttcatttttaagccctcaatgctctgggcatctgttcatcttcagcctcatcaggtgaggctagaacctgacctgcttcccaagctgtacccatctgtgccagaagtgagtgcgtgaccagcacagtggtgcttttctcagtctctcctgggggtgggtttggacatgcatgttctttctgggagaaaccatggaccagtgttgcagtatggtggataggcaatgccagcctgctctagatccccatgacctggcccacaactcccaagttagcaagaagagcagtgaggcagagcagaacaagtaccagacttcaagccatgccacctcggttctcgacagtcctctgtcagctctctgggcctcagtttcctcatctggaaagtgaggaggactatgcattttaactaacgtttaccacttagcacatgccagactcaaccttggaccctgggcacaaataaaaataagacatcgttctcgtcctccaaggactcaggggaggagctgggaggaatgtagacaaacttgtaaccagataatgatattgcaacttggtaagttcttaacccaggtataaacagaaagctgtcgaaacccagagggagaaccagttagatttcagatcacttcggcaaagccacaaagagcacaggctttgaagccagagcacttgggcaagatctggcttcccccttactagctgtgtgacttgggacaaattacttaagctctctatgcctcagttcctcatttttcaaatggaggtgatagtagtgcctacccccttggattgttcaagtgattaggacagtgcctggcatgtaatgagtcctacatatattatgctaatgttacagaattcccagaagtccatgaggctgaaaaggagctagtgaatggaagggaatccttaattgaaaaaaacaaatctagctgtgttttagagagaataaagacaagcatatattttgtgcttattaggtgtcagatggttcactaaaatccccacctgccacccccccttggatgcccataagtcagtgtccaggctgcaagcaggagcatttggcatggttaggagtacatggcatgcttaggggtgttctgcattaggactagggaaggaccactgtttgatctgcaacagctcccaaagaacacacacggataaactaaccatccccttgccagcctagctaggtcagacggtggaagcaaagtctggggcaggaacattttcgggcctcgttgattcctgcctctaagagggcaaataagcaggtgggtgggtcttttagcttggggaaggcaaaacttgggcagaacttggacctggcaggaatgaaggctgttgggctggctgggtgttagctgactcaggccaggtgagggcaactgtgggctgtttgggaaagcccttctgggaaatgcaagtcaaagagatggggtagagagactcaggaggctgggcaggggtgtttatgagcaatgcgagaggaaggagatcacatgaggccctggaaatacaacattgagtaggacaggaaaacaagtcacatgagcacacacctgagatggccagagtcacggaaacaggggtgcgctgggaaataatcaacaacaagctctcatggggcaggaagagccacagaatttgctgatttcccaagtgtagataccaccactgtagctaacttcaatctatcaatgtgatgtcactaaagtgcccgtgaaacattatttccaccgtacagatacgatagagttacagatggcctcaagtgccttgataatagtaaaatgtaggaaaagaattagaaagtgatgagttctgggtatttattacctttgttttgaatagagtttttaagttataaatttatataatttaattttaaataataaccatggtttgtaattggcttacaaagttcctgatgattgaaccatcagcctgaggaagttggagtaagctggctccaaagtgctactacttgggaatcttactgaattccttggagcctcaattttctcaatgttaaaatgggatctttttctcatcaaaataatcataactggatcacagggttcttgtgacggtcagaaaagtatgtaaaagcatttcaaaaactgtaagcagcatataaatattatatacaaatacaatttattctcatgggtacagtaacttagtggtcaaaagggtagtgtctggagcctggatctgccaatcctggctctgcttttgtttagttgtgtgacatgggcagatctttactgttttggggccttaatttcctcacctatggagtttctgtgaggcttaagtgaattaatattataaagcactcctaccagtgtgtggcacatggtgatcaccatttaagtatggactaaaattgtttatcaacctgaagagcagtcagcttgcagttcttccagaaccagaaggtcttttaactgagaaatccaagatcctggcctcctcacggcttggattaaagggccagttcccctctaagctaactgacttgctctgtgctactggccagtgctttttaaataatgaaccccgaagcctaattgcggagataaagatgctgctagaatcagattccacagccactcaccatagtagcagggggtaaaagagctatcttattacatgcctggctggctcaattacttcagtcctgacatagacagacgctggagccagcccagggcagagccctggagttggaggggtggctagctgccccacggaccctggtctcatttaccatctctgtcactatagtcccctgggctgggcaagggtaagagagtagccagataggataagagagatggagaaggacaatttgaggcaggagataggagtcatggctcatggctgccatagtagccacagagtggctcaaggaattcagggttctcaggcagagtcagagacaggtttgaggaaggcgtgtgggaaggtggtcaggatctcctcaccagggatgatgaattcacgtgccatgacagacagatgagaatagaaagacaggagcaaaaaaagccttggtctgcaaggtagaaaaaccaaggcaggttggtagggcaaggtttttcaaactaaggaattgcatccactagagagtcctgaattccacgtagtgggaccatcatgttctttttctcaacaaacttgaataaaatcctgtgacatagactgtgaatatagattgatgtccatcaatcccatttcctctttttgggtgctcagaccatgtttccctgtggcccttgcagctggagacacgtgactagtttctggccagcagagtacaggcaaaagtggtagaagccacttacaagcctaactataaatcctcccgagtgattctctcctatcctctcccttcccctccgtttccctctcctttcatcccctcccatctcctccctttccctctatcctccctgtccccatttatgccatgatcctgtgttgaagatggtggcaccatgatatagaaagagcctggagccctagaggaggaagaaggccattgagcagagcttcctaataaggatcaggctacaacatgaacaagaaatacacttttgttaaatcactgagatttaggggctgtttgtttcagcagctagcaagcattgccctgactaataactacaacaataaaatggaatggggtggaagggagggaacataatggaatatattcaattaaactagagtagaatagaacagaacaaaaactatcaaagtgcattgcaggtagtgaaaaataaatattgtttgatgaagcatttgtttcagttcagttcatatggatactcgtttttaatatgaattttattttttttgctggaggtggaggtggaaagttttgaaaatcactgccttatagctggagggagggttgggggtgtgaatcatgagaaagctttaggtaaaatggggatgcatatctacaaccctttaagaagcaagctatgcacttgctagccatccctaccttgtagatgtttgtcatggaagtttgtcgattgtggctgttcaatccaccttcccttcctttggtaacaccatcccagtcttagtctatatagtttgtctggagctaactctgtccgttggaatcaaggaggaggacacacatatgaagcctagaaaatcaaagtgttccattcctagagccatagtgattcagtgattggtttaggaatgaacacctgacccaagttggtccagtcaaactgggactttggctggagttgtcataaaaataagtgttttagttcccctggttttggagttgtgaggatataaatctgaagctgctggcagccatcttgctattataggagagaatgtgcttaagaatagcaccatcattgaagaaggcagagcgaggagatggaacaaaaccaagtcctgctgacatcatttgaactcctggatttagccatgcctgaagtcatccttgtagtttttaattgattctatactttcacctctttgcttcttcccatttgagttgggtttttgacagttgtaactgaaagggtcctgaggctgtgtcttctacatctttaagatgtctttttttttttttttttttggtaaaatgggcctcagaaaaagtggaaaacagctggtcctcaggatcctccagcctttgccaaggaaaagtggttttaatcactgaagaatgaggcttcaacatatggaaagactgtaaggtaaagtaaaggagaaactcattttttcatgttttctgttttgagaggatgaagaacagatgaatattattagagctactaatacatttctcttcatttatttagcaacaatttattgaacaccttccatgtgttaggaactatgttagtccctggaaattattaggccatggagatattattgagtaataacagaacaaattcttatgaagaatttgttacgtgtcagacaattctgagaaccttacgtttgtgaatcttactggtctttcacatctattctatcaggcagatactattaccatctctcgttttacagatgaaggaaactaggtgcagaggttaagctaagaagaatcagagctagtgttgaatgaaagactgatttccagtttaagtcttaaagtcattgaaccatgtggtctttgctgaccctaagctcgtagttgtccctgcaaacaaccatcctctaagcctcttaagatctctgccctgagtcctttctacttgaattcagtttaatgaagtctgactttgactttgacttgaactgtagcatcacttgttcaatttcaggcactgctcaacttactgttctgaaattaatctaaccattagcaatatgtgtgatctggggaaagggagggtaataaaaaatcacttagagatacagttcagcctaatggttaagaacacagtttggggactcatcctagatactgggtttaaatccctactctcctattttctggctgtgtatccttgcggaacttactgaccctctctgagcttttgtctctttatcttagaaacggggttaatgatttcaactcatctgattgttgcacaactgtcataaaataagaaagttcctggggcagaatcagtacctagtaaatgctggttgttgttatagctcttcctctttggctcttaactccctgtttgttaaatgaggagctgagcaagatgctctctgaggtctctgctggcataagtgtgactagtattttccaaatgttaatttgggaatggcaaattcccattgtcatggtttttcttcttaaagacttattttctgtcgtgtttctgtaattttgggctttgcatgctagtttgaaacagccaaaggagctttaagccttttgtgtgacatcataacttggtgcccataaattgatgaaaagccatataccaaaccaatgaggagaagtccaggggctgatggtcctggacattctcctggtttggtgctgggggcagaggtggcttggcttccccttgactcttctgacaatcctgaagatattctcaaccccaagctagaggtgatgacattgtgggaggaacagggagtgagggagagtaggggaggggaaaggagagacagcaggaggaggagagggaggggaaggagcaggggagggaacatgagagtaaaaaaagaagagggtgttagggagaagggcagaaggagtaaggggtggggtaggggcaaggggtcactcctcccacaagaggaggggagaggcaggagaaggggcaggggaggagaggggaaggctagaactcaactaactaggagaacacagacatagagctgggtgggcaggttggggaggtcagctcagacctcactacaaaatgttcagttggttctggtagaacctgatttctgaaccattttgttgaaaaacatggaagacaccccaacacagaagaccatatgggactgaggaagaattaatgagcatagaatcctctttaaaggtgaagctaccataatgcaattgaacttttttttccactctgcatgtcattcacaaatcatggtttattttacccttgaaataccaaagcgaagacaatgcaaacaaaaaaataggtagaataaatgcctatacttctcaacaagacactcttcaatgggatacattttccttcaatcactcacttatgcactgctttatcaccagtcgctctttgagcatctattctttatcattccctatgctagattgtagggattcagagataactaagacacagtccctgccctatacaacaatgaaaatgctatgccagttttgatgctcctcccttttagaggtaagagttcatgtcctcttcccttgaatcttatctggccgtaatgactcacttgtagtcaatagaatgaagtggaaataacttatgaaattaagtcacaaaaggcaatacagcttattcttcagtttctgggacactcacacttagatcttgaactactatgaaagaattccattctatcactgatgggcatttgggttggttccaagtctttgctattgtgaacagtgctgcaataaacatacgtgtgcatgtgtctttatagcagaatgatttataatcctttgggtacaccatggaatactatgcagcaataaaaaaggatgagttcatgtcctttgtagggacatggatgaagctggaaaccatcatcctcagcaaactaacacaggaacagaaaaccaaacactgcatgttctcactcataagtgggacttgaacaatgaaaacacatggatgcagggaagggaacatcacacgctgaggcctgtctgtgggttgggagggtagggcagggttagtattaggagaaataactaatgtagatgacgggttgatggatgcagcaaaccaccatggcatatggcacctatgtaacaaacctgcacgttctgcacatgtatcccagaacttaaagtataataaaaaagaaaaattatcccaaagcatgatacatatgaattaaatgccattagtctttacacactattaaaaaaaagaagtattccgactaccctcaggccaccatagtgtgaggaagcccaagaagttacatgaagaagtaatgtgttctgataaacagacccagtggatgtcccagccaacagccagatcaactgctggacctgtgagtgaagactcctccgggagattccagcccccagccattcagttacctctaatcattgagtcttcctaacttagatcccaaacaacaaggagcagatgcaaaccatccctactgtgtcctgtttgaattactgactcacagaatccatccataggcataataaaagtgttgatttatgtcaccaagtttggggacatttttaaatacagtagtcataattgaaacactgtccatttgtgaaacttgctgggatttatagacagcaatttaaagaaaattaccatcctcagaagttcacagcctgaaacgggcagacccaacccgaggggcttaatacttgacaaccagaatgtgtgaaggggactaaaaatctggtcctctaggcagctttattcaacagcctccaaatgacaactaaagccccccttcatatcatgactcagggatatgccacctgcttaagctcagtttcatttcccaccagtcagtcttttctaagagcaaggatacccacccatgatggccatgcatctaagaaaatgtgattccactatggagtactagaatgctagatctaaaggaggtttagagatcattcagtccaaccctcgcacttgcctatcaaggaaattactgaggtccagaaagattggatgctttatccacagccacacaactagttggtggccaagtaccaggaatcagggcccctgcctcatttctatactctgctgcctcttcacgtgaacatcagggaagccattgtactctcagtggcatcatgtggaagttccaaacacagatcatggagtcctataaacctggtaagaatcccagttctgctccttgccaactgtacgaagatggccaagttcacctcattgagcgtccaatttctcatctgtaaaatgggggataattataatacttatcaaccagggtttgttatgaagattaattgagatgatgcacagaaaacacatagcattgtgcctggtccatagtaaatatttataaagcccaggtctctctagaatgaaacattctggcctataccttgcagaagtacagaaagatgtgtgatggatttggggttgagtgagggttttttgttttatttatttacttatttatttttatagagatgggtcttgctatgttgcccaggcaggtctccaactcctggcctcaagcaatcctcctgccttggcctcccaaagtgttgcattgtttgtttgtttgttttagtttgagagcgatcaaagatggttcaggccagcactgccaccagctctctggtagaattaagtggctgctggctttagctgagcagctataatattgactcatcctcccctctcttccctggatgcctgccagtagagaactccttgagttgtcccttctgagacatctctccctgtgaatgccatctcagcttctctgggtataaggcaccttgatctgattctttccctgtcttgaatctccttgtgaccatcagcattgaagactccctgtgaatacctatgagggcttgcaatgtgatcagcttcctgccaccttgtgtcagtggagtcccatgggagcagcatgaatgcaccccagggaaatgaacatccatctgctcagctctggctcctgacagatcgcagcaccctactggcctcctatgccagggcaacctccagatctcggctctaaagttggggagacaactgctgggagccctgaaacggaaggaagctgcagaggacagcccaagctgacatttccatgcaggagtgtggagccaatcttatgtcagcagtggtgccaattaccagagagaaagggctgaatttccttctggctttcatgggaccatgcagtcattctcaaacatttcttacaaatgtagtgtcccgggcattatcttaggcccacagcagggtacgaagatgaacaaaatggcaatgtccctgctttctacaggctcatagtcttttgagagaagcaatgacaacatagtgtgatcaatattgaatttgtcatatgtgtgacgttagtaagggatttagaggacatggttgttggtactgttggaggtacagaagtggggtgaggaaaacttcatggaagagggtgacattctgcctaagtgtgctcaacaatgaatagagtttggctaaagtcataagtgagatttaggcctagggaacaggaagtgcaaaaaaaaaaaaaaagggcagggggactgaaagaatatggagtgtttgagggagtacaaaccacctaatgggaaggggaagagaaggatgggaaaagagccaaacttgagagcccttgggagcatataaaatctgaaatgtgtactctactccataggcaaagtgaagctacagaaggttattgagcaggggagggccacatagttttatatttcagaaggataacactgctcccgggatggagggtgaagcagatgaggctgaactgaaggtggggagcccgtttagcagactttggcttcatccaggcaggaggagatgcaagcttccatgtaaaatggaagaagttggtagggttccgtctagcaacagcctgaccaggctgaactcacacacactccttctgtatctcccagaccctgactagcagcaattgctgcataaatatttgttaaagggatgaacaaatgtggaatgccctgtcttctaaggacttctgatgaacgtgaattggtgactttgcaagaccccagattgtgcttagatcttgaccttctgacgaggaacacagagccttcagtttgcgacagggcaaaagaggactgctattgctctgccccagtcattctaggtagtataaggctcattatttaggaggagctatgaaacaggccatgaagtttccctggcatccactaattttgtctggagtccagagacaagggagcactcccgtctcttacagttcctgtgtccatttggaactgttagctcatctttgtgttttttaagtcctggagatgggaggggtgccagggtttgggtgccctcagaagcagatccagagacaaagattcaaatgcaagtatagtagtacctccttatctgagggggatacgttccaagattcccccactggatgcctgaaactgcagatagtgccaaaccctatataatttatgttatttttggattggatccctgagccagctaagagactcacaggtggggagcatctacagcgtggagactctggacaaagagaagattcatgtcctcaacaggacagagaagacagcacaagattttatcacactcagaacagcacgcaatgtaaaactcatgaattgtttatttctggaacttttcatttaaagtttttggactgtggttgacctcaggtaactgaaaccaagctctgaaagcaaaactgtggataagggggagctgctgttgtttatttggaaggtggtcttgggagatgctggttggaaagtggagaaggagagagaaggaagctgctacttcatgtgtaataggcaagttcccactatggactcctgcggagcaattcctttggggactctggaggatggctgaattcactccagagttatcctcctagagggatgaggaagctgggctatttctccatcaaatctcacatctgtcattgtttgagggctgcttccagggacattaactctacagcatttccatcttgccctgagcaccagccaagtgcatcctcgaagagagttatggatgtttttcagttggcagcctgaatgtagagggaggaggatatgcaagggtgccaataggatttgctacaggagctcacaagcacagggagggcattctgctccaccctaggaagattcttcagtccctaagttcagtgtggggagagtagaacagtgtggggagagtgaaaaacactgaggttcgatcaaaatgcattgctgctctcatgcagggtattgaggtgcaagtgtcaagggcccggatttatttatttatttatttatttatttatttatttatttatttatttatttttgagacagagtttctctctgtggtccaggctggagtgcagtggtgcgatctcagctcacggcaacctctgcctcctgggttcaagtgattctcctgcctcagcctcccaaatagctgggattacaggcggctgccaccatgcccagctaattcttgtatttttactagagacagggttttgctatgttgaccaggctggtcttgaactcctgacctcaggtgatccacctgcctcggcctcccaaagtgctgggattacaggcgtgagccaccgcacccggccaagaggctggattttaaaaaatatctttgtgcctgtctcattcaaagttcaaataagatgatcactttgggtttcagcatctttttgagagtggtgggtaggagagtaatactatcatatggcatggctgtgggattgggggttgtggagggagactttagtacctccgtaatttccatcagccttcctccaaagccactttgaataaacatagagaccacagtgaagccaggtgactgcaagccaatgcagctagacaagtcgctcagcccacttcagactctgtagaacagaatgctatcccaagtcctaagacattccagagctggcaatcttcagagaccttggaacagtgatccagtaagtcttagaatcatggtggtgggggtggggggcacgtgttgaaaaggcagattcctgggctgcactccctgatgctgattcagtgtctagagagagtgggacgtagcaatttgcattttaaacaagaactccagatgattcaaaataaaggttgaaaagtacagtcttagaatgttttgagcatagagtaaaaggaagaaaatggaggaaaaaaagaggaagaaagtgaaatggtcatgagatgaggaaaagaagaggaagaacgaggagaacacctcaaatagggcaggcggctgtgagtggcataggttgccaggcaatgacttctgtatcaaataattgctttacagctctgagcattaagaagcagccttcccgctaataaactctgaaggcaaacatgagtatttgaagctacataatgtaaaggagtagattaaagtaagagagattatcaggctgtctttcagctggagataaatatcttttctgcagtgccagatcaagatgagacaggttgtgtgtacccggcaggtcttcccacacattacaacttagagggaaccaacacctcaggaatacctggggaaaaaggagacccaagaatgcctgcatctcatagtatacaaaaacattaattttccagaagctatttttttctgctgtgttgttcttacgtgagctaaacacagcatcattatctcagtaatagccaaaacaaaaacaaaacccaaacactcaaaaacccaaaatgtctctgaagctgcttacaccatttcagtctcgaagggaacttaatgtggatctactaagagactgcatgggtcaagttcaggcagcaaaggacaaactcttggtagaggtttgtccaacggttctcacacttgagcatgtgtcagaatgaccaggagggcttgttaaaatgtattgtttggccccatcctcagagggtctgattcagcagatggggcccaagaatttgttggtgctgctggtctggggattatacattgagaaccactgggttggaccaaagtccaaggtttagaccaaggtctagaatgtccaaggaacaaagtatatgaaaacttgtctaaaaatggggcaacaagagaaaatatccacagaccctagtcaaaagcatgagcaaggggaatcctgaaagatgaatactcccgtatcctgcttggataaacatttctacctcctacctgcatgcctgcttcttggggaaaggaccttggtgtggtggcgccataattctccacactccttcaagatgaaagtgatgtatttatatctgctctattaaaagacaccaagtaaaatgggaagctctatgtcaacccttggcttagaattcaggtcattcccagccttgggaaagactagacaccttcctatgaataatggactccctggagacccttaatttccacccattaattttcaacacttggaacaagcatgatacatggtctcatacttccagtttctttcagaatcctccaggccattttatttatttatttttttacttccctagaagtaaggcagttttgctggacataaactcctcgggacatgtgacttgagctatgacttctcacaatatacaaaaacaggatctccttagttgaggctgtaaattaggctaatggaaatgaatatggtagctctctgaggtcactaggagacactttggggctatacttactgcaaaaggagaagggcagctactttaaaaatcccagagggggctttcattcatcttcctcaggccaccattctatcccaaccacaatgtacctctccatttgcatgcacaacccaactagagccctttactttggctttcactttcatctgcatctattgattacccacagatattcagatctctaaatcatagcatgaattaaggtcatagattaaattaggaataagacattgaaggagaatctctttttcttttcttttctttttttccttttttttttttttttttttttttgaggtggagtctcgctctgtcgcccaggctggagtgcagtggtgcgatctcagctcactgcaacttccacctctctggttcaagcgattctccctcagcctcccaagtagctgggactacaggcacatgccaccatgtctggataattttttttgtattattagtacagatggggtttcactgtgttagccaggatggtctcgatctcctgaccttgtgatctgcccaccttggcctcccaaagtgctgggattacaggcatgagccactgtgcccagccaaaggagaatctcttagaggaacacttcataacactttggggggctcccaggcttctatgagaagctcacaaaatcagtggaccttcttcccagaaaaatgcacctatagacaaccttttgcaggtaattaattgtacagatgcctcaggttaagaatccatagatcatactacagaagcatatactatacatactatatagctcatacctcattgaagtacatactatagctcatatcccattgaaacagaagatgctggtgtaggaggaggaagggggacagaagaaggaggaagaaagaagggcaagcctcagggtaagcagcccctgtattggtcaaagggacataacactagctactataacaatgctctgaatttcagtgtcttgacactgaaattttctcttgtaggtgttcctggacagcaagtgagtgacttgctcacaggcggtaattcagggacccaggtttcttctacctggtagctctactgtccttcagaacctcagagccctgtgcattcagccagcaggagaaagaccactactaaggtacaacagcttctttgaaatcttagcctggaagtgctggccatcacttccagtcatatttcatcaatgagaactgattgcacgaccacatctggatggaagctgggctggagaatgtagttcctgtctgtgaaaccatttcctagcaacaactccacaccacggaaagcagagcataaagttttggtggccagcaagccatattgcttcctaaccattgcatgcaagtgaaatcaggttaaaatagatggcaagctgccttgaaagggaaaagacattatgaagcccaaggcatgggtagaatagggcagctgtggccccaccctgttggtagcaagtagatgaggttgcagacaaattgtctttcagcctcagaactttctaaaaccaggcgattaaacccctccttatctctagctctatcctttcttcctacttcttacaaaagtgccaggccctggaacaatttcccaattgcaatgcgtgctttcatacccatccatctgagcctgatttcttaaacctaagtaatttatacaacatgtgaatcgacaaaatatgaatgcaaaagttgtttctatggaaattaagttgaaatttttgagagattcaatagtagcaggtagctggaaatgctgttgaattacgtgtgtgccaaacaattgtaaaagatggaaaaaaacatttaaaaattgtggggagcctggatttggttggttagttaaaaaataagtaaagcagagaattatttttgaaaagtggtacacacaatcattaaacattctagttaacttaaaacatgtaaatatacattcattcactaagcttttgatgtgcgtccaagtcattttctttgaatacaaatctgctgataggagttgtgggttttcctttttgcatgagccatacttaaaatgcactgtctataatttccagttgtagtttcttgaaagtggagcaagacacttgtgaagcaagctcagtgcataatccccccaatttttagatgatttttttcaatcttttacaattgtttggcacacacataatttaacagcatttctagctatctgctactatcaaatctttccaaaattttcaacttaatttccatagaaaaaactttttgcattcgtatttcatcaattcacactttgtataaattactaagttttaataacaagtgcaaccggaataattgtcataaagaggtttgggagcaaacacaatcgacttgcagtaagtaagtagagcttacgcagtgagaacagacacataggctagtagagtatggcttggagtgttcagtgggctattgacctcagtcagcatggtttgcagagagagtagggagccatggttaatttggtgtgggttgccagcctccaaggtggcccacagtgatccttgccttttggtattcagaccctgtgtagtctcctcccacactgaattcatggctggtctgtgtgaccaatagaatatggcagaagtgtccattgtgtgactgcagaggatcagtcataaagagtgcaacttatgtcttggtctcttaggtcattcactttgggagaagccagtcttcatgccatgaggacgttcaggcagccctgtggagagaaccacatggaaaggatctgaggtctctcaccagcaccaatttgccagctatgggaatgggccaccttggaaggagactgtccagcccaagtgaaggctgcagataactgcagctttggccaacatttggctatattgctttgggaaatctcaagccagaaccatctgg

SEQ ID NO: 4348 - DNA, 57952 bp, human; identical to SEQ ID NO: 3142

SEQ ID NO: 4349 - DNA, 49929 bp, human; identical to SEQ ID NO: 3143

SEQ ID NO: 4350 - DNA, 57952 bp, human; identical to SEQ ID NO: 3142

SEQ ID NO: 4351 - DNA, 49929 bp, human; identical to SEQ ID NO: 3143

SEQ ID NO: 4352 - DNA, 228046 bp, human; identical to SEQ ID NO: 3146

SEQ ID NO: 4353 - DNA, 8613 bp, human; identical to SEQ ID NO: 3153

SEQ ID NO: 4354 - DNA, 32199 bp, human; identical to SEQ ID NO: 3154

SEQ ID NO: 4355 - DNA, 228046 bp, human; identical to SEQ ID NO: 3146

SEQ ID NO: 4356 - DNA, 211437 bp, human; identical to SEQ ID NO: 3150

SEQ ID NO: 4357 - DNA, 8613 bp, human; identical to SEQ ID NO: 3153

SEQ ID NO: 4358 - DNA, 32199 bp, human; identical to SEQ ID NO: 3154

SEQ ID NO: 4359 - DNA, 228046 bp, human; identical to SEQ ID NO: 3146

SEQ ID NO: 4360 - DNA, 211437 bp, human; identical to SEQ ID NO: 3150

SEQ ID NO: 4361 - DNA, 92298 bp, human
cggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccaggtaaggagggaccgcccccagggaacgcgtggaactaccctctcatgtaactcattctccttcccaggtctggccctcttgtgacctgagaccttgcaattaagagtttgctatttgaatctagtccttgctagccagtgattaccaccccattgccaccccgtgctccttaagattcaggggacctaactgttgctacggctacttttcacagaattctttggccattgttcaggatgagaatgagccgcctccgtgcccgggtccaaactgcctctttttgcattgactctgctttttttggacgagaagaggtgtggggggtttggacagactacactgaatgagaacagtagacaggagtgaagaagctcctgaagtttacgcaggactctgcagtgtggggcgacagctaccgtccctcccatgagctgtcttggtagagacccacctgggaagcccttaggggctactttggttgctattttacagataagaaaattgtgaggctagaaaggtcactgcatgtagcaggtcagacccaaaggctcccaagctcacagggtcctatgacactgcccatgtggtccgaggtatgaatttgcctgctatgctttgtattcctgggctaaaattatgtgtgggtccatcagtgtaagaccactgaactatttttattcctagtgaagacagcagctatgtttcttgccctcaatcaacagcaactatttatagggccttcaaagtcaacgaaggaagtggcattcaggggttagaggcctgacctgcaagttgggagccatggtcatttccaaggcactgaccattttcccttcttaactaatttcttagccttgtttcctcacttaggaaatatttgtggtgtatctgttatatgcaaagcactctacaaagtgctggggttacaagaataaatgatcgtagtgcagtaacatttatgcataaggtataggtccaaagtcccttaatctgttttctttgttgttgtttgtttgtttttgagacagggtctcactctgtctcctaggctggagtgcagtggcgcgatctcggctcactgaaacctctgcctctcgggttcaagcgattatcctgcctcagcctcccgagtagctgggactacaggcgtgcgccaccacacccagctaatttttgcatttttagtagtgacggggtttcactgcgttggccaggctggtctcgacctcctgacttcaagtcatcctctcaccacggcctcccaaaagtgctgggattacaggcatgagccactgcacctggcctcagagtccattatctgaaaccctttggaccagttgtggtttgcccatcagaaatgtttggcttttagaaaggtaatatgcgtacaacgtactatatataccataataactgcagccagatctgggcagcaccccttcatcaaacaggttattacttccacatcagaatatgaatattcacataatttcagtaaaggctgaaaagagtttcatattagttcggctcatcttttgccaccaaaagagcttgctgcaaacttacgaaaacactttaaattttcagagcttactggcttttgagattgcacatgaaggatgatggtctttattttgagagctttgaggaaggacccctcgcccagtttgtgggagcagtagaggagtcctggaagagatgatgttcaagttgagagcagaagaagtaggcaggcaaatcaaggttatttttccccttcttccttggaatatattctaattacatctataaagtgttttaaaatccaagttgaaaaacctttcccttcatgactgtgatggagagggctttaaggagagctgatgaagcttggttcttttgtcagacctgggtttgaatcccctgctctgccttgaatgacatgtgtgacctttcttgatcccttctgagtccatgccctcatctgtaaagtgaggataataacacttgcttccactgagtgtttctaaggaaaaaattagtgcctactatcttgtctggcacctactgggcaacagtaaataatgggtgctcttggtggtgttatgattttgatagaggccacacgtttgtgcccaggcctcgtggtccttgcaggagtactctggctcatggtgcgccctttcctgaaggtcctgctacagctccgcattccttgagcataaatatgtctccccattgatgccaagagatcctaagtacagatacctcatcagtttccttcctttgcatcaagcagtggccaaaggcatgaaaggtacccttaagtctttgttggtagaagacttccagcaggacctgagtcatcctaataacccagctatccaggcttgccttccctcagaagcaaaagaattgtcttctcattaaagcaaatctgtgagattggactttcctccccaacattttaatgattaaaaaaaagttgtgtgagcctttagttgtatttattttgggggtagttggtgagtagccctcatgtttgccctctttttcccttcctgtgtcatcaagctcttctggctaaccaggatactcccagcacagttctgccgggaaatgccatgcgcccacaagtgcaggattgcacccattcacccccacaactagtgttcacagttgtagagccctaacccattcaaggcctcatcaccttctctgagtaatcttaggcaggtcccctaactactctagaaaaacgaatgagcacttttatgttatgtatattttaccacaattaaaaaaaaaagaatgagctgcacgaacggtttctaaagtgtatgttgtatctccccacctgctgtagctttgtgcagatgtttaggaggcattttttttagtgtcagctggtaacaagttctaaactctgtttctgatttgctttttaaattgagatcaatttacattggtttcatttgttagaaatcattttgtgttaaatatgccaagctaatcaccatttgaaggggcggcctgcccctccacacctgtgggtatttctcgtcgagtgggacgagagactgagaaaaagaaataagactcaaagacaaagtatagagaaagaacagtgggcccaggagaccggcgctcagcatacagaggacctgcaccggcaccggtctctgagttccctcagtatttattgattactattttcactatctcagcaaggggaatgcggcaggagaacagggtgatagtggggaaaaggtcagcaagaaaacatgtgagcaaagaaatctgtgtcacaaataagttcaagggaaggtactatgcttgaatgtgcacgtaggctagatttatgcttttctccacccaaacatctcagtggagtaaagagtaacagagcagcattgctgccagcatatctcgcctcctgccacagggtggtttttctcctatctcagaatagaacaaatgtacaatcgggttttatacagagacattcagttcccaggggcaggcaggagacagaggccttcctcttttactaatcttcctcagcacagacccttcacgggtgttgggctggaggactgtcaggtctttcccgtcccatgaggccatatctcaggctatctcagtggggagaaaccttggacaatacccggctttcctgggcagaggtccctgcggctttccgcagtgcattgtgcccctggtttatcgagaatggagaatggcgatgacttttaccaagcatactgcctgtaaacattttgttaacaaggcacatcctgcatagccctagatcccttaaaccttgattgcatacaacacatgtttttgtgagctcaaggttggggctaaagttacatctcaaggcaaaacagttgttcagggtacagatcaaaatggagtttcttatgtcttccttttctacatagacacaggtaacagtctgatctctctttcttttccctacaatcattcttctgttagaggtaatagttggttcacataatttcagtaagggctgaaattattaaattaattaaattatttaatattaattattaattattaaattaaattattagttaagctaacatcttaattccttttcctgtatctgtgaaagagaagaacttttcccattagtcatttgccaaatatacttgctgctaaatattatttgaatctttaatgcaaagaatgaaagagctatggttacaaaaaggtccttttgcaggtttgattttgtaaatatatatactctaggaagtatctttaaacatttgttgcctttaaaagaaattcttagattgttttggctcaggtaagaaatatgaactttgtacatttttttcactaacagctgtttgaaggctccttaataaaagtattaagtatgaaatggtgatgagaatatggatcagaaggaaaaacaatggtcaaggcagtgttcactgtaacgacagattatttggtataataaagcaaataactaagagactgggacagtaaatactgttatttaatggccacggaatttaaaatgagaagaatggaataaataaaacatggagtatggaacaaatagtaacaataataaagaggaatttgggagagagttaaaaaagatataattaagtattagaaaataataatatggcagaagaataggaagagactggagtgaaagtgtttttttgttttgtttgtttgtttgtttgttttttgagacagtcttgctctgttgcccaggttggagtgcggtggcatgatctcacctcactgcagcctccacctcctgggttccagtgattctcctgcctcaacctctggagtagctgggattacaggtgtgtgccaccatacctggctaatttttgtattttaagtagaggtggggtttcaccatgccaggctggtcttgaactcctgacctcaagtgatccacctgcctcagcctcccaaagtgctgggattacaggtgtgagctactgctcccggccaggagtgaaagcattctgagggccttatcccattaagaaggaggatgaaggtattatcctagcttttaagataagagtttgtgtttaagcattaccattaatatatgtggcatatataactttatttttattttaatttttttttgagacagagtctcgctctgtcacccaggctggagtgcagtggtgcgatctcggctcactacaacctctgcctctcaggttcaagcgattctcctgcctcagcctcccgagtagctgggactacaggcatgtgccaccacgcccggctaattttttgtatttttagtagatacggggtttcaccatgttagccaggatggtctccatctcctgacctcatgatccgccctactcagcctctcaaagtgctgggattataggcgtgagccaccgcgccaggcctctggaatatataactttaaaaacgattgcagaataaagaaaatctgatcatctgagtgaagggaggaaaaggctgctggggagggtaggaaataaagaaaaaagtgtggtaaatataaagtacaaaataagatgcaaataaatccaactatacagtattagtaatcacaagagtcttcctcattagtatagtggtgagtatctccacctgtcacaacgagtataaatgttgaaatccaccagataatagaaattattattattattattattttgagacagagtcttgctctgtcacccagggtggagtgcagtggcatgatcttggctcactgcaacctccgcctcccgagttcaagcaattctcctgcctcagcctcccgagtacctgggattacagtcaccatcatgcccagctaatttttgtatttttagtagagacgggtttcgccatgttggccaggctggtctcaaactccttacctcaggtgatctgcccgcctcggcctcccaaagtgttgggattacaggcgtgagccactgcacctggcccaggtaatagaaattatttttttaaaactttttaaaaggtgtgtgtcatttgtaagagacaaaacctaaaacataggatactgagaggttgaaagtaatatagtgggacaagatatactggacaaaactaaccaaaaatacgttgatgtatgaatatcagaccgagtagactttgaaaattttttttttgactttgaaattttttaaaaattatattagggatacagaatggtattgctagatgacagagggctaattcactaagaaaaatatagcaattttaaatctgcagaatactaacaacatagcttcaaagtatgtaaagcaaaatttgacctaactataggagaagttgacaaatccataatcttagtgagagtttttaaaccccctctctcagatactgttagatcaagcagagaaataattaggccatagaaaattggagcaccgtaagaaacaaattcgattaagtacacttacatagaattccgcactgaaccaataggaaatacttacttgtttcagcttcacaagatattttttcaaaaagtgatgacagattagaatataagggaaatgtcaaaaaatactgaaagatcaactttatgcatgccacatttttttttggccaaaatgcaagaaaattagaaagcaataacaaacaattgctgatgcctgtcatatatgtttggaaacttagcaagcctgcttctgaatatgtcatggatcaaaaaagaaattataaggaaagttatgaaagagttagaactgaatgacagcaaaagcattccaaataaaaatgtatgggattacagctaaagtggggtttgaagtgaaatttatatccttacatgtatatattggaaaagaagaaagatttaaaaattaataaactcacagttgtgaaaaggacaacagagtgtattcaagaaaatagaagaaaggaaataagggtacaagcagcaattaatgtactataaaacagacagcaaagatggacaaagtgaaaaactgattttttgaaaagactagtaaataggcagacttctggcagggttggtgagagggatcaggagagggaggagggacaaatgaataatacaggagtcccccttattcacaggggatacattccagaccctgtgggtgcctgaaaccacagatagtagcaaccatatataaactgtgttttttccctgtacatagatacctatgagaaagtttataagtaagagattaagaacaataataataaaattgaacaattaaaacaatatactgtaataaaaattatgtgaatgtggcctctctctctctctcaaaatattttattgtatgtagtattttcagaccacagttgaccaccagtaactaaatgacagaaagcaaaaacggataaggaaggactactatattaagagtgggctgttttccagataaaggttaccagtgttaagaaaaaattaaatcctgattagacctgtaacctttaaagaaatggaatgagtccaaaaagtcctagtccaagatgcttttacagagaaggaccaaggaacatttagagattgatttctttatgtatcttggaagttaaagaatttgggccaggtgcagtggctcacgcctgtaatcccagcactttgggaggccaaggcaggtggatcacctcaggtcaggagtttgagaccagcctggccaacatagtgaaaccccgtctctactaaaaattcaaaaattgaccgggtgtggtggcaggcacctgtaatcctagctactcgggaggctgaggcatgagaatcacttgaacctgggaggcagaggttgcagtgagccgagatcgtgccaccacactccagtctgagcgacagagtgagactttgtctcaaaaaaaaaaaaaaaaaaaaaaaaagaatttgacttttattctgagtgagaagggaagccctgagagggttttgagcaggggaatgatatgatatcattcaaatcatgtttgaaaagagtcactccattggctgcatggaatattgactgtaggggaccaaggagcaaagcagaatgaatgaccagttaggaagcttctgcagttggagcatgatgactcagacaacggttgttcaagtggagacagtgtggaatggtgagatttggagtaaatttcgaaggtagagacaacaggatttactggtggagtgaatattgggtgtgtgaaaaaagaaaagtcaagaatgacttcaagattttaggcttaaacaactgttaggatggaattaccatttactgcaatggagaaaattgtggggaagcaagtttagggtggaagatagagttttgttaagttcaaggtgtctgttaggtatctgtattagtccgttttcatgctgctgataaagacatgccagagactgggcagtttacaaaagagagaggtttaattggacttacagttccacgtggctggggaagcctcacagtcatgacggaagacaaggaggagcaagtcacatcttatgtggatggcagcgggcaaagagagcagtgcttgtgcaggaaaactcccctttttataccatcagatcccgtgagacttactcgctatcacgagaacagcatgggaaagacctgcccccatgattcaattacctcccaccaggtccctcctacaacatgtgggaattgtgggagtacaattcaagatgagatatgggtggggacacagagccaaatcatatcagtatccaagtagaaatgataagtaggcagttgaatatgtgagtctagaagttaggggagaggtctgggctagagacagaaatgtgggagtcattggtgtatgtgtggaagttaaaaggccctgagacgagacgagacgagatcacaggaacaagtacagacagaagagagatgaggttcaaagaggagacccccaaaagtggagagatccagattatgagggggaggtactgccaagggggatgagaagaagccatcagggaagtagcaggaaaagcagccaagggtcagtgtcccctcaaagtcctgtgttgaagccctaatctcaatgtgatggcattaggcggtggggccttcgggagatgattaggtcataagggttagggtcctgatgaatgggattaatgcccttctaagaagaaacacaagagagatggttctcaccaccaccaccatgtgagctcacagcaagaaggtggccatctgcaagccaagaggagggccctcactggaacttgaccctgctggcactctgatctcggatttcctagcctccagaattgcaagaaatatatttctgttgtttaggccccccgatctatggtattttgttaaaacaacccaaactgactaagatggaagtcggaaagtgattcaaggaggaggaagtaatcagatgagtaaaaggctaataatgagacaaggtcaagtagcatcaggactaagagttgaccattagatttggggatgtggaagttattggtgaccatgtccgacagtttatgtggagtataagacacaaaaattgggcaagtcgaattcaagagagaagggaaggacagaaactgaagattctgagtttaaattgttcttctgaagagttctgctgtaaataagagcagtggttgggtggagatatggggttgggagggtttttttaaatatgagaaattatgtttctggtggaaatgatctagtagacagggaaaaactgataatgcaaggagcaaagtcttggcgtgcatgagagcagatagattgtagcatatatattgcaggtgaccttagagaggagcacatccatcaaaacgagggaagcagggcacaccagcaccatgttcccttttgattgcttctgccttctcagcgaaatatgaagcacggtcactagctgagagtgaggatggggaggagttattggaggtttgagagagaaggtacgaaacagtcctttaggagaaaaagggaatgaatggacaagggatttctagataatcgttggacagcattaagggtcattaatttaagggagttcagtcagtgtggctgtgtgtttttctctagccacgtttagctgcatgggtgcaccctcagagttggcagaggcagatttagccagagctggcattttgcccagtgagtacaatgcctccattgttgtagacagaggggcaagggattaacagataatccctatcttaaactgtttcagataaaagataaagagagacagctctcaactcctttcagatggccaataccccatgatagtcaaacaaggcatgttaaaacataaaacttacagaggaaagtcacttatgaatattgatattaaatacatgaagtgaaatattcagaaaatgaatcaagcaatgtatataaaaaacatcatgatcaggtgtggtttatcccccaaatacaaggaaatttactataaaatctattaatctatttttaccacattaataaagaagaaaaacagtgtgatcatctcaatagatatagaaaagcatttgataaaatccagtatccattaatgattttaaaagcacctcttaaggccaggcgcggtggctcacacctgtaatcccagcactttgggaggccgaggcggatggatcacctgaggtcaggagtttgagaccagcctggccaacatggtgaaaccccgtctctactaaaaatacaaaaattaggatgtgatgtggtggtgggcgcctgtaatcccagctactcgggaggctgaggcaggagaattgcttgaacctgggaggtggaggttgcagtgagccaagatcatgctactgcactccagcctgggcgacagaatgagactccgtctcagaaaaagcacctcttagacaatgaggcatacaatggaattttattatcttgataaagggtaatgtgaaaataaatctacaaacctcgtaagtaatgtattggggaaagatttaaagtcaagaacttgaaggatccccactatcaccccctctattcagcattgtaattgtgcccccatgtaacagatatgaaaaggaaataagagtcatggagattattatttgcaggaaaaaagtgctacagaaaacccaaagtgactggaactagagttttccatttttcaagcaagcttcccatatataagatctatatgcagtaatcaaggtatccctttatggcagccacaaacaattcgtaaatgttatcatttcttagaaaagcattcacagtagcaacaaaaactgttgaatataatgcaagggctagacatgcctggagaaagttataaagctctattgagggacataaaagaagacaaatatgaggagagacacagcatgttcttgaatgggaagattcagtgttgtaaagatatattctccccaaattaatgtataaattcggtagactgccaatccaaacccaaagagactttttcagggaaattgatcctaaaattcacatgctgtagtaaggggccaagaatagccaagacacattttaaatagaagaggggaaggaatgccttaccagatttcaaaacataaatctaaggtcattaaaattgtgtgatattggcacaacagcagacaaattgaccagtggaaaagaggaaagacctcaagaacagaaaggatagattattcaataaaaaatgttagggcaattggctgtccatatggataaaaagaaattctgactttctcttagaccgtgcacaagaataaattccagagggaataaagacctaaatgtgaaaagcaaagctataaaacttaaaatagaacacttttatgatcttgagacaggaaatgatttcttaaactaatcataaaaatcataaatcataaaataaattgataaattcaactatatgcaaaagcaaaacctcttatgacaagaagtttatctaaacaaggctaaaagatgagctacagaatgggaaagatttttgaatcacgtcttggaagcagatcctctgccctagtcaagctctcagatgactgcagccctggccaacatcttgactgaaactttatgagaggctttgagctagacccacccagttaaagctgcttctgaattgctgacccacagaaactgtgagagataatagacgtttattggttttaagttaccaagttctggaattatttgttatttagcaatctataatacaaaagcttaatcctaagagagtccttagagagtcagccatttatataattgattggattcaggtttccatcttagttgagagcttgttttaatttgatgaaatagcaggtaccatcattgtttagcttctgggtttgtaaatattgtcttttcattacaaagagaagagatatgcaacatagtaccagaataaccaaaaaaatattttaaatccaggtgacttacttcactgtatctcttcaaggtgattcccttcatcatttatagtaattttatatatttctataatagtatcatattctacaatgtaaacaagcaatgtgcagaggagaaagcaaacgggctaaaagatggctcaacttcactagcaatctgagaaagtaaagcaaatctaaacaacaaattcagactgacagatggcaacagttttaaagcataattctaagtgttggcaaggttatgaagaagaggtaagtgtcatgtgtcactcatgagaagatgtattagttaaggtaggctaactgctatgacaaacaaaacccaaatttctttggctaaacacagaagtttattttgtacacatataacagtccattgtgggtccaggtcattgggcggttcacccagatacctgggctaccagtggccttaccatcttcagtgtgcagcttccaaggtcaccctggatgtagacatcccgctggtgtaccaggaaagtactaaacattattcatgggaaggctttatgggcaaggcatggaaattgtgtactttactttcattcacattcctttagctaaaactcaagcacagggccatgtggaactgcaagggatgatgggaaacatagtataactaagtgcctaggaagaagaggaaattggattggtgattaggtagtggtctatgctgcaagatgtaaactacagactgttaattggtacaatcaccttggaaagcaatttgagatggtgaaactgaagcaatgcatgctctatgacccaggaggcccatatctaaatatagacactaatgatgtgctcttactcactgcccaaggaaacatgtacaaggacatttgttgaagcattgtttataaaagaggaaaattagaaacaatctgactgttcttcaatttggaaatggacaaataagagatctagctacactggaatactatatagccattaaaatgaataacccagatttacatgtatcgaactggataaccctcaaacatttaaagttgaatggtgactatagttgactgtagttaataacaatatattgcattcttgaaaattgctaagagagtagattttaagtgttctcaccacaaaaataagtatgtagggcaatacatatgttaattagttcaatttagccatgccacaatgcacacatttcaaaacatgttgtatatgataaatatatactttttttatgagacagggtatcactgtcacctaggctgtagtgcagtggcaccatcaaggctctttgtagcctcaacctcccaggctcaagtgatcctcccacctcagcctccccagtagctgggactacaggcacatgcctccacacctggctaattttttattttttgtggaaacgaggtcgcactgtattgcccagtctggtctcgaactcctggacttaagcgatcctcccacctcagcctcccaaagtgctggggttagaggcatgagccatcacatccagcctaatttttgtctattaaaaaatttaaagacgagtaaaaaaagcaagttatagaacaataagtatagaatattactaggtatgtagaacttttaaaacacctgaaatatggttatatcttgcttatggacacatacttttcttgtaaaaattttaaaaacatggacaagaaaaatacactccggctttggagtagtgtgacagttcacagagggtgatccccagatccccgaaggtccctgacaccctttcaggatctctgtgaggtcaaaactattttcatcccattcgtaagatgtgatttgccttttttcactgtgttgacatttgcagtgataatagaaagctggtgctttagtacaaatcaaggcagggactccaaactagactaggagtcacatactataaaaaacaaaaaaaagaagaaaaggaaaaaaaaaacaattgcatttaagaatgtcctttttggagcattaaaaattttttttcaagtttaaactttatctgatctttaaaatattctgtgtgttgacgtgaaaagtacatataaagcacttccgctgcacaccgaagtacgatggctgcttctaggaaaatcatttacacagttgtctgagctgtgagctgaactagcagtttggtttttttcttggacaccatttttgcttgaaaggttgtcaaattatggtcattcagacttgggcatttggcagacattttctcaaaaatgagcaaagtgagcctattgctgcaaggaaaacaactgacaatatttgttgccagtgataaaatttaaactttgaattgaaatgagattttggggaaacttttttttttttttttaaatatacagagtttctctcttgttgcccaggctggagtgcaatggcacaatctcggctcactgcaacctctgcccccgggttcaagcaattctgcctcagcctcccaagtagctggaattacaggcgtgcaccaccacgccccgctaattttttgtatttttagtagagacagggttttaccatgttggtcagactggtctcgaactcctgacctcaggtgatccacccaccttggcctcccaaagtgctgggattacaggcgtgagccattgcccggcattttggggaaacatgtatgagcttgtgagtcactgtgagcttgacttaaagctcctaatacttgacttaaagcttcctgatacttaaaaaacttttctgatgagattggtggtgatattaacaaatgtggataatgaaatatgtcaacatttgggctaactgcataactcactaaactgatgtattccaaatgaccaatgcttgatgttataaaatcacacatgggcaaatgattcattcaaagctcaagatagaccaatggattttaaaacgtcagagtacataaagctcattgttatgatttcagattccacatttcaactggcgtttaagaaaccgtccacttgttgagttttgattgtatcaaataatattcttaattatccaaaaagacttaaaatagttctccctgcatatctgtgtgaagctggattttcttcatatacttcaactgaaataacgttgccacaaagtgaatacagaagcatatatgagaatatagctatcttctattaagccggacattaaagagattttttaaaatgttaatcactgccattcttcttgttacttttttgttttgaaaaaaaatttttttaattttttgtagagacaaggtctcgctattttgccaaggctggtctcaaactcctggcctcaagtgagcctcctgcctcagccttccaaagtgctgggattacaggtgtgagccactgcacccggcctgaaaatttttttttaatgttttgttttgaaattatacaaaaattttacttatgttgacatgcggtaggtttttgttaacgaattagtaaatatttaaaaatttttcagttttaatttccaatatggtaaatatgagtagctagaatgcatataaacaaaagctcttagggggtctccagtaatttttaagtgtaaaggggtcatgagaccaaaaagtttgagaactgctgggaagtttgtgaaccattagagaagaccacaaggaaggcttcaacttgatctttaactttttctttcttcttttaataaaggaaagactggcacagttacagcagaatgctttcatttgttggatctgggtgatggttatatggatatgggctatattgctttctctttgcttccctatatgtttgaggctttttttttttttaaataaggctatattaaacatagtgtaggagtcagctttgattcctcctagaatggaaggaaattccccaccttgaatggggagaattttctaatggatagagaccaccgaaacacatctcagctccacccacttctgtctgtattcattgtcaccaccctcatcgaagccaccgtcatctcttgactggaccacccctcttgtctcctaattcattccctgcttccactttcagactctcctctccaaagtagtacatgatcttccatcaggcaccagactacactactttcctcttgcagccttcccatagtgttcgtaactcctagaacaaaatgcagagtccctcctgtgactggccagcctctgtgagtcggctgcagccaagccagcagctgccagtctcccctcactcgccaccagtggggtcctgctcagtgcttagtaacaggctccactgacttgaaaactttgcctctctgtcaagagtgaccccaggagaaaatgagagaaagccacccccagtttctcattccttccagcaaacccaagatctttgccaacaagtctggcaccaccacccagtcggcagcctaggagtctttttggccccttttttcccctctcccacctatatccaatccatcaccaagccctgttgattttacaccctaaacattcctcaagcccacctgctgcctctgttcctctgtcaccaccaccattcttgtctgagccaccagcctcgccgtccctcctcctgcagtagcttcccctcccgtctttttcctgcatccagtcagtcccttccctgtacttctccccgctgaagccaaagtgcccttctccagggaccagctccagcatttcgggcagcactgggtccaattggggcagaggtgacattcttagtgcctagttagacagggactggctgacaggtggttgtctggtctttgtgttaaagggatcactccatagataacattttccccctcctgggataacccagggccctgccttctgcacctcctacttcagctctttttggggacagccaggaggaaggcttttgctcttttctggacagcgtttaaataatttagtgtcagatgaaaacatttgagtaattcatagaaaaaaagtgctcaaatcctccatttacaaatcaaggactgcaataactcacacaagggagagatttggaattgtttcaagctttgcagggatcaaaaagatctagtcagatcacttagttgccttttacagttaaagaaccccaacgggccagacatggtggctcacgcctgtaatctcagcactttgggaggccaaggcggggggatcacttgaggtcaggagctcaagaccagcctggccaacatggtgaaaccctgtctctactaaaaatacaaaaaaaaattagccgagtgtggtgtcgcacacctgtaatcccagctactctggaggctgaggcaggagcattgcttgaatccgggaggtggaggttgtagtgagccgagatcgcgccaatgcacttcagcctcggtgacagagcaagactccatctcaaaaaaaaaaaaacaaaaaaaaaacaaaagagccaccaccaagagagttgaggggacctttttcaaggtcaattcttctcgtgagctgacagccctgtgtaagcactgtcttgggccaggccagataagtggagatacaccagattgctgtgaatatgaaacaaagttgcattctccttactttatgtgttaaaatagtgaaactttaaaaggctatttatttaaatattccactaaacttagttctgccatattgttccttgtcgcttatatttgaatatcactgttaactagtgaaataaataccacacctgtctcacaatgggtagggagaacataattaatgttcataaaatacatctagagaagtggttcttgatcaaatgggttacagatccatttgagaatttgatagaggctgaatatccaatgctctccttagaaaaaacgctcgcacaaaaatttcaggagtctcgtagccttccgtgtccctgtccacaatgtgcaccccccacacacaccccagaaaggcgattcatggactcgtagcggatcctctggaggccccaggttaagagccctattgtagagtgacatgtggtgtcttcatgctccaaacccaaaccccgacctgaaacatttggaataaaagtcacgcttataattgaaaatatcaaataatgacatctgtaatacccctgttcagctgaaagttgactagcgcagcacccagtaatccaccagtacttaatatttcaggtatcggcaagagggaactgacagcccccctgagctgaatgtgttctgtatgtttccacaacaccaggctcaggacttacatctcagtaatcctccctccttactacacgaattagtgagagaggcaaagaattaaagtctcctaggagagtggtaaagtcgtttacacgtttgattgtagctaaagagcccagagcggtttgtgtgagtttcgaaagttttaagatgagcgtggggatctggaacgaagctgcaccaagtggatgcctgcaatgcttggcttctaacccagtttatttccctataggccatcattcatcatgtcagatggtgcaaatacctcggaccaggacagcttgcagcttgtgcattgtttgtaaacccagaggggagaatcgaataagcagcaatttagacaaaaatacattatttgaaagtgagaattgcacacctgtgatccctttaagtaaagcatgaggcatattagagcttatggtttaaagattattctccaagccacctgaggtttacctaccaaattgtacaaaatctatcttttaaactaacttaaaaagaaactgttacttatacaatcagtagtctcaattgtagatgcaatcattttaaaataaatgctattataattcctcctttagaacacatctcaggtgtaaagcattgctcttccccactcctctttaatatttcaaaaggcagtagctggaacagaattctggtacaagtgaatttaaccagttgttggcgttattgtaacaggatttttcactttctattttttgctttaccaatggagagtggtggtaagaaatcatgtcttttcaacatttatcctggtctcttgtgcgtattttatttgaataattgaactatactttcttccctcgaaactgagcaaggtggggatatgcacttagcgattcttaatccaaaggaaaaaagaccaagggtagggttcgtctgaggcctctgacctctgtcccatggagtgaaggaaagggaaccaaaggcctgggagatcagggaaggctttgcagaggagggagctcccacaggagaacagtttgccaggagagctttacaggcagagggaggagcaagcgtgtgcacaggcccggaagtgccagagcagtgtgtgtgcaggaaacactaattcaggttttcttgggggctgaggagggagtgtcaggtgatcaggtgatcaggctggatgtgaggggaagagccaacacatgagccttggatggcaatcaaagggatttagattttatcttgtaggcactggagaattctgaggagtgcagaaatcttcgaattctaggtctgtgacctagagacacagaaagggtggtctttctgtgaccaccctttcaggaggatggattggaaggaaccaataccagaagcaaggagatcagtgaggagctatttcaattttcctgtgggacacaggtaggggaaaaagggaattggtactttgtgttatttctggtgggtagatgacaacattcatctctgtgccgtccagctagaaattgaattgcaaactgttagatataagtagtttgctgctaccatcaggcatatgtcttttgcctggtattgcctcactcttccatgtctttaatagcaccaaacacatgttttatggtgtctagttcatcatggccatataagcattcatggttgtatttgtcaggattctttcagttgtaaatgacagaaactcacctcaaacagccttaagcacaagagagaatttattgctcaaataactgaaaagtccaggggattggcctagattcaggcatgtctggatccaggagctcaagtcatcaaatatggtatgtctctttacagtgccctgtttgactctgagtgggctttattctctggtagggttgtcccaggtagtgacagaggtatccctgggagctgcaggtgatagtcttctagagtggcagcctccacagaaagcaagcttttcctgtagtggctccagcgaaagtcctgactgacttagcgtggctctcaggtggtccaacttgggttgtctgcccatctctcaaccgtgcccagattggccaggcctggaccacatatccttccctgcagctgggccaggaccaaagtaagccccaccagagccacactgggcagagcaggggaaattataggccactactagaaagggaggagacaggggctggacaggcagaagcaacaacatttccatcaggacagggacgaaacgaagggcccaaggggacaccctgagttgaaatcggaagagttcagtaaagggaaaaattgaatccctcttggagaggacaacctttcagctctttgaagcctccccttaacacctatgttcttcctccttcccatgatatgtggcttttagctttttcattgccctaatcaccctcctctggctatgctctaggtagtgaatgtctcttttaaaacatggtgtttggtggtaacagagtacaccagatgtactctgccaggctggcgtttggtgaggctcttatttcccttgttccgaaaacaatacttctgttaacacagcattggctttctggtacgtggtactcacactgttggtagggtgctgttaaaatttgcagtcagtatcatccagttgaattttgtttgtttgtttgtttgtttgactgtggtataagatgggtttagtagactggcttcatgaattttcttgtacctaagtgttgggcaagctgtggctgggtcacagagtggctgctggtgtgaaaggtgatttggcagagagaagaagctctgtttaaagatttattgggatcccaggggtgggggtgtatgtgtaaagggagctgagtcaattcaaatgtgggagtgatggctaataaaattagttcagcaaaaatttatgaaacatgtgagcccaatgtacaaatccttgttgaatgctgtttagtttgtttcaatctattgtccaagtccttggcattctgctgttccagtattggctcagcatccattttgcagtccttacctgcccctccatgcccatgcacgcacccacaaaggagcagtgtatgttactatttcaacatctctgccttcttctgttgttaaaatctaacccatcccctgcttgcttggagaatcatcatctttgtattgccaccagtcaagaagattgtttaagtgttgtttctcaagctgatgtgatgaagactttagttttttgtttttcattttacaatacaaaattataatgttgaatctgtgtttttaaattacacacacaccaccctagggagtcatgtatcctgtattctctggtcagcttccaccactgcaccctgactcccactgaaattcactaccctaacttctgcctccttaaacttcacctccgtcctgtgacattactgttctctatttgacccatctcagctctgagttgagcaatgagccatttcctgtacttgaagcagctccccggttttgtccacttttctacttttaaagcaaaaatgaggctttagcttctgcttgagtcattctcaaggttcatgttgtgtatatctgatttatttcttttgagtttcctaaagaaaggctgaacagaaggacatgcataataataaaatgagctttttttttttttttttttttgagatggagtcttgcgctgttacccgggctggagtgcagtgtggcaccgtctcagctcactgcaacctccgcctcccgggttcaagtgattatcctgcctcagcctcctgagtagctgggattacaggcacgcaccaccatgcctggctaatttttgcatttttagtagagacagggtttcaccatgttggtcaggctgttcgcaaactcctgacctcatgatccacccgcctcggcctcccaaagtgctgggattataggcgtgagccactgcacccagccaaaatgagcattcttaagtggtaaatttacttgtattagctatgtataatacaaatatatatagacagagaatgtctatacttttaaatacctttgaaaagatatttcagactgtaaatcagtaaaaatatagtgatttattatatattcatttatttatttattaggtacctaactaggccaggaccttgcgctagagtggtaaacaaaaaagataggctttgcctttaggaatcttgtagtatgaaaaccatgtttcagattgtgccagaaagacatcccatgtccatggatcagaagactcaatatggttgagatggtagtattcttcaaactggtctacagctgtggaattgagattgaggttctttttcttgcatgtgtatgtccacttgtcccaacactgttaaaaagactgtcctttcttggattgtctttagatctttgtcaaaaatcagtttgccctattcatgtggatctatttctagactctgttctgttctgtccatctatgtgtttattcctttacctcttgttaggttcatacacgtctaagattgttttatcttcatgatgaactgaccctcatggttcgctgtgtctttcttctcctgtgcacagaatgggcagtgatatagtttggatgtttgtccctgacaaaatctcatgttgaaatgtaatccccagttttggaggtggagcctggtgggaggtgattggatcatgcagatggatttcttatgaatggtttagtatttgtgagaaatggtttagcaccccttggtgccatccttgcaatagtgagttctcccgagatttggtagtttaaaagtatgtggcacctcccccatctccctcttgcttctgctctcaccatgtgaagtgcctgcttccgttttgccttccaccatgaataaaagctccctgagacctccccagaagcagatgccccatgcttcctgtacagcccacagaaccatgagccaactaaacctcttttcttataaattacccagtctcagatatttccttatagcaaatatgagaatggcatcataacagtcagtgctttagatacaagttgcttgagtagcctggtttctagagggaagataacacagagcagaaccacagccggccaggggtggacacaaggcatggacaagaagcaaacgtttgttgtaataagccactgagatgttaatgttgtttgttaccagaccataggggccaagctctgggcccaatccattctaggtcgtaggggcctgccctttatttttcatcaacaggagccaacaagggcacttttcctacattagaaacccagaagaggtggagaaggtaagagaggtgaacaagtggctggagataaaggacaagctgttcagctcttggccccttgcttttgatgaaactcagtttctattaggctcctctgtctctgtggccccttctcatagagtttaaggatatcattggcaggttcttctgaggcagggatgctaactgtcagtgcaggttcaggctatctccactaagaccggcttgtaatacctactgcttatgattcttagctatcctctgagttgccatatctagagatctgccccatttcctgtccttcatgactctacatcaggtcacctgatataggtgggagagtgggagagtggatattattacagaatttgcccctgatattaatttagtcatgatttttttcaggcaaagtatacagagagtttagcaaagtaaacagagaaaatttatatgaatgagcaaaattcaaggctaaacttgaaggggaaaggcaagacctgggtgtggagaggacagagtggccaggttttttgtttcaaaaatgtcaatgtgataaaatatcttcaccagtaatgtttatagtaatgataaaagagggcaccccaaactttggtgtttttttctagtaaaaatgatggttacatcgaactcacttgcagattcctcccctagctacatcatctgacttcctgaaattattgtaattatatgaagaagaaataatgctaatgaaagccgttcaaacaggtgaataatattaaacatcgcaattattgagcagttatgtgtgccagacagagtccaaaaagcttgatacgaattaattcatttaatcttcacaaataaccctatgaggtgtacacattgttataatccccatctgacaggtggacaccgaagtcatttgctcaaggtcacagctggatgataggagagctttgaacacggcagtttgattctagcctgctcttaaacacaatacatggaaggttgtctttctttgtaggtagaaatggtgaaatagtacctggttaaaaagaaactaggccaggtgtggtggctcatgcctataatcccagcactttgggaggccaagtcgggtggatcacttgaggtcaggagttcaagaccagcctgaccaacatgggaaaaccctgtctctactaaaagtacaaaaattagctgggtgtggtggcatgtgcctgtaatcccagctactcgagtgactgaggcaggagaatcgcttgaatccccgagacagaggtttcagtgagccgagattgcaccactgcactccagcctgggtgacagagtgagactccatcacacacacgcacacacacacacacaaaagaaactgaaacttaatcagctcacagaagagcaaatccagtggcccgccctccctcccagacaagaatgactggatggttaaattcactggtagtcagggaaataaaaattttaaaaataaaaatggtgatgagatatcactttacatccatcagactgacaaaaaattaaaactattgataacttatggcagagatagcgaatagttatgaaaatttaaagtgtatacacatataatatgccaacccagcagtcccatttttgggattctattccatggaaataaaagcactgttgaatatataaggatatttattatagtccttgtattgccaaatttaaaaaaaaatcccagaaaacaaatgaatacccattattacaggtatcttctatggaatatgatgcagcctctaaaactcatgaatttgaattatgccagatgacatggagggacctcataggtcctgttgaaagagaaatgcagggtgcagcagtgtgtatcatatgatcccaccatcccgctcgttaaaaacagtgaccctggccgggcacggtggctcacgcctgtaatcctagcagtttgggaggccgaggtgggcagatcacctgaggtcaggagttcgagaccagcctgaccaacatgatgaaaccctgtctctactaaaaatgcaaaaattagccatgcatggtgtcatgcacctgtaatccgagctactctggaggctgaggcaggagaattgcttgaacccgggaggcagaggttgcagtgagtcgagatcacaccattgcactccaacctgggtgacaagagcgaaactccatctcaaaagaaaacaaaacaacagtgacccccaccttcaaaaagaaaacctgtgcatgaacaggaatttatatataattatatatatgtatatatacttcacctgtttaaggggtacaattatatatatatatatatatataatctggttttagtaacacataggaaaaaatgtatatatgaggctgttatatggagtgtgtggaattgctgacatgaggggaggagggaaccaagcaaaaaagagaaggaagaaagacaactgaaaaagatacatctatctgcttatggttacgtatttctacaatgctctgtgtgggtgcagatatagctaaatagtgtttttcaaagattggaaagcaacatatggttaaaatgatcacatctgaaaccataggcttggcttggaccaatctccccaccatcctcctgtggtctgcatttgcctgtgtttatgtttagcttgcagaatggcatcagacagggcagcctttttctccctcctccattgccatacttaaagtaaagactccagagctccaaagagatggacctgttcaggtggttcataagcatcagtaagtgagagtacagatatggcagcatagtccatctccaggcaagggaatgactcaaagacaaaaccactgggtcatccctattagaagggaaagcagtggctgggtgcggtggctcttgcctgtaatcccagcactttgggaggccaaggccggaaaatcacctgaggtcaggagcacaagaccagcctgactaacatggtgaaactccgtctctactaaaaatacagaaaattagctgggtgtggtggcaggcatctgtaatcccagctacttgggaggctgtggcaggagaattgcttgaacccaggaggcagaggttgcagtgagctgagatcacgccattgcactccagcctgggtgagaagagtgagactccgtctcaaaaaaaagaaagaaaaaaaggacagcagagcagaagtggcagagtatctgccaatctgtggtcatttcagtttttatgaatcacatcaaaatggaaccacccccatcttcttccaacacaatgcactggtttttatagacttaacaagagaagcaagtcaaaaagtaaatattcctattgctgagtgcagtaacaccctaattttacacggcatgtatgtgtatggttctgaatatgagaatcccctgaaacattcagactgcttctctgtagttgaatgagggggacagacagtatagctttgggtgaggatgaactaatctactccaacagttaagcgtgtctaaagagtaagatagatgactttcagttaacaggacagggatatttcataatccaaaccacacttgtcactatgtgtaagcgatcactgctgtgtcaccagaaggttgtttgttttagtagactcatggttggtgggcacacaaggaatgggttgagttcttactctgggtctcctgatgtttccctgtccccggcttacccaacagacctcagaacagataaagatgcttatgtcgttgttgttgtttttgagacaaactctcactctgtcacccaggctggagtgcagtggcacaatcttggctcactgcaatctctgcctcctgggttcaagtgattctcctgtctcagcctcccaagtagctgggactataggcgcgcaccaccacacccagctaatttttgtatttttagtagagatggggtttcaccatgttggccaggctagtctcgaactcctgtcctcaagtgatccacacgcctcagcctcccaaagtgcttagattacaggcgtgagccaccgtacccagccaaaatgcttatgttatacgttatttaaaaagaataccagtagtccactattggaataagatttgtactttcagtcattcctaggtttcaattctggttgactttaacatcagtgattcatagttgttggccgtagaaccatgtcaatatatagaatgccattgcccctgtgggtaatatcagttgagttttaaatgttttgatagagggcatagatttgttagaggagaaagtcaaatatttaattccttaggtgggaacatgtgaaaccatgccagtgttttttacttaatattggcagtatcactatgaaagtacccagtgcagttttttcatgagctctcttgtaaataatatggtgccctttacagtaatgtaatttttttaagcttacaaggttctgattgttatgatacattttattagatatgtacaaattttcaggaaatgtcaacagaggctttatcattatgtgactctttaatctgatttctaggcagagtttattaggactggcttttaaaaaattaatagctttatttacttaccatacaattcacctatttaagctgtacaactggatggtttttagtatattcacagatttgtgcattcatcaccacaatcaattttcgagcattttcatcaccaaaaaaaaaaaaaaaaaactactagcagccactgacttccagattctacctctactcccagcccagtcaaccactaatctactttatgtctctatagcgttgctttttctagacttttcatacaaatggaatcacacactatgtagcctttggcatctggcttctttcacttagggtgatgtcttcaaggtccatccctgttgtagcatgcatccatacttcctttttctgccaaataatgtttcattgtttgtatagaccgcatttcgtttatccatttatcagttgatgagtatttggcttatttccactttttggcttttgtgaataatgctgctatgaacatttgtgtataattttttgtggcaaggtctggctttttagtgactcagttgcccttttaaatacccgtgatatcatagctaaataggactcccagatgtcctcttgcttggcaccttctgtttaggcacatgaagtatctggattgcccagagagggaaagtggcttccctgggcacacacagctagagagcggagtggggccctgcctccaggtttcttgctcacaggttcaatgctttacctattagtgcggacacatgaagactgaagaagacctaaggtctgcaatatgcagctttgtgaaagccttgcagtcttttcctgtttgctgtttcttctgttttaccacttacaacagtgtggtctcgtctgaaagcaaaagaacataagagctggaatgtttctgagagattttctagtcacatatcctcattatacaagtgaggaaactaaggtgctgagaaggcatgtgatgtctcacccaagatcacactgttaggggcagagcaaggactggaactttggtctccctgctccaggtcccggtcctcatctaccctgttaggacaagcatctgttacccagggactgcatgaaggatggcactgagccattttgtgtctcttctctaatagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcaggtaatagtgactgacagctgtatctcggctgctcagccaccttctccttgaactgaaaaacccacagagaagtagctgtgtgtgcagaactgtttgggtgtaggcctctcctctatttctgctatagaatattttggggaggtacttagattatctcaacctcacattggtctttctgtttgagtttggagattcccacataaaacaatgacaacatccaaaatcacaccaaatagaaaatgaaagcaaccacatttcttttttttttgagatggagtctcactctgtcacccaggctggggtgcagtggcgcgatctcagctcactgcaacctccgcctcccggtttcaagtgattgtcctgcctcagcctcccgagtagctgggattacaggcgactgccaccacgcgcagctaattttgtatttttagtagagacagggttttaccgtgttggccaggctggtttcgaactcctggcctcaagtgatccgcccacctcagcctcccaaagtgctggaattgcaggcctgagccaccgcacctggctgcatccacatttctaaccccaaagtgtcaatttgtataattagttacatttctttcacacgtactttatccattttgtacatatttatacacaagacatcatcataaactgatatgttttttaaaagtcacctcaccacagcttcacattccaaagcatgtactcttcagagtagtcacactggaaggatatttatccaaacattattgccactgcttaaaatatttttgaaacttcccttaaaaatacgtttctaatttgaaccattccaggaaagcaatcttattaatttatggtcaccctttaattttgaaccaaattggtgttatccaatttgggggcctatattattcaccatacaggacaatgaagtccttttattgttttccaaaatccagaaccaagatacctaccaaagatttgccatcactgagtttgtaacaaaataatctgtccctgaacacaggaggtattttccaagtgttttgagtggtagcattgaagtagagagcactgaaatataaaaatcattctcttggcatgagagcccttgggatttatctttgattcagacattcttcgatggcctcacggtcagtggatcgtctgtgacatggtgtctcatgtattaacgtagcattattgttgttatttataatgaggataataagactagtaattggttacaataaatcctattattcagaaaccttggctgtcacttgcattttgttagagctttactcggtaattcagtgatggtttcacaaatggccatgttggcaaacattacttttgggcaggcgtggtggacttagtgtaagaaaaataaattaccaagaaatgtgacataaagctccagagtactacacttacagaaattgtgttgctaagatgtcaacgaggagtcactgaatttcagaggtggcagatatcatctgatccaacccctttatttgagataagtcactttgtcgagatttttctttctttatgatggagtggagaggacatgaaccatcagaacactcacgtaggctcgggactggcctttccagggcagttgctgggcagcactggcttgccagccacagtgatcaggaggtgattttcctgcagcaaggaccctgggccgtgttgctgattctgctttatctccacagaacgtggtgaagctgatgcgaggtcttctccagtgcatgatgagacaggtaggcagaacccacacacgtgtttgccaagtgggcattccatgtcattgtaattgtgacagttaacatgcttaagacgttttgtacttttcttctcaagaggaagagaaattgaaaatattttgcttactttctctctctcttttttttttttttttttttttgagacagggtctcacactgtcactcaggctgagtgcagtggtgcgatcatggctcactgcaacctcaaactcctgggctcaagtggttctcccacctgaggtgtgtaccattcacctggcctttttttttttttttttttttttgtagatacaatatctcactatgttgcccaggctggtcttgaacacctgggcgcaagtgatcctcccaccttggcctcccaaagtgctcggattacaggtgtgaggagttaccatgcccagctaccttctctttttaaaattattttcagtaactttactattgtatcacagtctcaaaggacagtttctgagaatctcttttgaagaggtacatggataaaaggagaaacatgctttttttttaatggagaagaaaacatttttttttaaaagccacgtctagaaagccatatattattgtttattccatcatgtttgtaaaagggtatattttcattgagatgaaatgcttgagttttaaaaacttgatattattgtttagtggtattttcagtgaggggtaaataaaacaattcattgagcatgtactgcacacagaacattatactaggatctgcacaaattcaaagacgaagacaaaacagtcctcactctcagtcagcgcaagaaaagacatagttgctcttttcctttcaacattaagaaacaagaaattgaaatttaaacaggttcctttcctcccctccttttctcccttcttccctccctccatctctccttgagtatctaccgtgtgtcacagctggggatatgtagacaaggacaccctttgtcatgacccgtcactcctgcagatgagactccccccaggctgggacattttaggcaagtgggcgaaaagaatccccagcacagtccctctgtgcggtgctgcctagcagctgccttccatccctctggctcccagaagtagcagataagagctctagatccaggtggctggccatggccgtgatctctgccagccatgaacccccataactatgcagagcgggcttgccttctccctcaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggtgagctggggttgctggagcccattgtataaggagtgacaatccggaaaaggggtgggaggaggacaggtagcggccagtgtgtcaggccatgtgctgcttcactgctttaataaaatacctcagacaaggccatttatacagaaccgaaatgctttttctcgcagttctggaggctgggaagtccatgaccaaggcactaccaggctcagttgtccagtaagggctccatcctccaaagaggaggactgctgtgccctcccatgggggagaccagaagggcaagagagccagaggctccacgaagtgtgttttgtaagagccttcatcccatgtaggatatgtaggatgggaggagtcctcagggcctaatcgcctcttatggccccacctcttaataccatcacattggccacacctcaattttggaggggacacattcaaaccgtagcaatcagtattataaatcagcagtttacacaaaagaaaagcatgcttctccatattctgtgcatttgtttctgcaatagggcagggagtgcagggaccctgcctgtaacctgcagagaggacagtcaccctccacctgggcaccagcagggtaaaggccgttgagctggctctcttagcttccctctgttgaacacagaacccctttactgtcactctctcctagttcctggagccacctaggtctggtctaactttgacacttagctgtctgcagaccatctcacccctgctcttagacttttctcctccaggatcagcagccctgtcctttcagctctcccactcactaccctggtcaccctcttctagacacaccctcacttttccaaattatatttgagcaccaccatttctgccactcagcagtgtgcccagagcgggctgagcagcccgctactcagcgggctgagtaggctcacagtttgtcggcggtgtgccttgttcccattgaagccagagccgctggcctctgtggcagcctggacgccaggcctctctctttcccactagggtctcacaccaggtggtctctctctcacaatggcatgtgccacagatgctcccccaggttagggcacttaacggctatgtctgggagttcttatcacctaccagtccagtcaactgatgtgtctgaggcctcccattcattgcagactgcaagtgtgaaactctcaaaatcccagaaatcagtaagcagtattgttatggctgtgtgaataaatcacacatttatgaagttacgttttggctatgaaagttaatatgagctcactgtagatattttggaaaatataacagaatacaaagaaaaaaattccactgccaactttcatttggctgcatcttctccaagtcttttttcctgtgcattttttacatgtttaaggtcacattgtacacataaacatagtctttttattacgtagcgttataacaagcacttctcccgtgatataacaagctcttcataaacattattttagtgagtttatcagtgggtataccataattaatttaactattccttccttcttttattttgctactataactaatgttgcaataccaactttgaccccatcttcatttacttccttctgagagttagatatcactcaaaggcaactcatatatattgccaaattgttttcagtttctagttaaacttagttctgattgaaattctaatctggcttactagttaagctgccctcattgatgtaagagtccatttcctatcatatccatagcagcttccagaattcatactttaaaaatacctgtatttgttataactgactatatttttctgcagggtggaaggccagctcctggagctggggactccctgtctcccactgggaaaagtattcacccttctctttggctctctcaaagatagagacagtgtctctggttcttctggactaaaatccttgctctgttggaaccttccccgcatcaatccaacctgtaccagaggtcccaaatctctctcatccctttctactcataggcacacacaggaaagtggagcccttcctttccttctccttattttccttccttccctccttccttccctcttttcggagattagacactcactgttatgccttacttaagacttcatttttgatgcctttggaagaaaaatgaaaatgagggtaaaagggtttatttcctagtgtgatatttgtaatttgtgactggcagctctctgcaacatggcttcataacctcattgtttttctttgctaggcttacgtatcattttcactctcgatgaggtggccttcatacagaatcttgtcttttacatagaagctgcatataaagtcgctgtaagtatcaaccctggtagtcttttcagatgttccagtcaacaaaaagaataaaaatcatacagtgttttgagggccaggctgtttggggctcaccaaaaggttagcgagactagcgctatgagattgtgtcacctccacacacaaactgcatatttttgtcctggaatagagttgggggtttcaggtttttggaatgtactctgtgctctgtctgaatccattatgcttgttatatttttttatttattttgtttatttatttatttttaaacagagtctcgctctgtcaccctggctggtgtacagtggcatgatctcagctcactgcagcctctgcctcccaggttccagtgattctcctgtctcagcctcctgattagctgggattacaggtgcctgccaccactccccgctaatgtttgtatttttaatagaaacggggtttcaccatgttggccaggctggtctcaaactcctgacctcaggtgatcctcctgcctcggcctcccaaagtgctgggattataggcgtgagccaccactcctggcccattatgcttgttttattttattttatttttaatttttttatttccataggttattggggaacaggtgctgtttggttacattaaagtcctttagtggtgatttgtgagattttggtgcacccatcacccgggcagtatacgctgcaccctatttgtagtcttttattcctctcccgcttcccacactttccccctgagtccccacagtccgctgtgtcattcttatccctttgcatcctcatagcttagctcccacttaggagtgagaacatatgatctttggttttccattcctgagttacttcacttagaataacagtctccagtctcatccaggtcgctgcaaatgccattaatccattcctttttatggctgagtagtattccatcatatatataccacagcttctttatctactcgttgactgatgggcctttggttggtcccatgtttttacagttgtgaattgtgctgctataaacatgcatgtgcaagtgtcttttttgtctaatgacttcttttcctctgggtagttacccaggagtgggattgctggattaaatggtagttcccattatgcttgtttgaaataagatcctaacatgtcctacgggatgcatatgtgctggcttgagttggggctaaagaggtagcagcattagcaccttggtgggagctgggatgccatgagcgtcgccccaaccaggccacaggtagaggggcttgagccaggcagagccccagcctgggccagatttgctgagtataaatgtgtataaaccccctttcctccgagcttctgtctggtttggaaggcaaagcctgaggcacctttacacaacaaccccagtgtgtaaagctctcagggaaggagggaaaaggtaaaggctggttttaaaaaagccactatggtctaaaggaaggtcagcaaaggttttctgtaaagggccagagagtaaatatggtcggctttacaggccctagggtctctgtcgcagctacttggctctgcctttgtagcatgaaagcagccatagacaacacgtaaataaatgagcatggctctgtcccagatagactttgcaaaaataggtgggaaactagatttgttccaaagactgggtggagttccctgaccccaggtctaaagcagtgattcccaacgagaggcaatcttgccctcccaggagacatttggcgatgtctggagacatttttggttgtcgcacctggtcagtaggtgttcgtggcatctagtgagccaagactaggactgctgctagacatcctacaatgcacaggcccccctccccccaccccaatgactcagattacctggctcgaaatggaatagtgctgaagttgacaaaccctggtctgaagaaacttgagaagtctttgtggaaagggtgggcattgagttggaccttggaagctgagcagagtctagatcagcagaagggaggagatagggagtttgggtgcaggaatagcttgtgcagtcccagaggcaggaacaggctctgagtgtggctgggtgggctagggggtgcttgaggaaaagggtacagaggaaaggagtagatttaggaggaaagctgacattggaaaagagtagaacataagtggatcttatgttccactctcagcttgtgggtgtgtctaaggaggccaaatcatggggcatatggccattcagagagagagatgtgaatgtgatccactaggaaatacaccacttgtcattttagaccctgaaacaaggggaagcagcaatcaaagcagtttttgaggatgaatcacccagtgccggggttggaggaaaggtgggttgggctgcaggaaggcgcagatgagaagagtgctcaagggaagaagcccaggctcagtcaccaggcacgctcagcagggaagttgctctaggatgcccgagtctcaatctctatattttgaaaatgttctggccaggcgcggtggctcatacctgtaatcccagcactttgggaggctgggacaggtggatcacctgaggtcaggagtttgagaccagcctgaccaatatggtgaaactctgtctttactaaaaatacaaaaattacctgggtgtggtggtgtgcgcctgtaatcccagctactcgggaggctgaggcaggagaattgcttgaacctgggaggtggaggttgcagtgagctgagatcgcgccactgcactcctgagcaactaagccagactccatctcaaaaaataaaaataaaaaaaaagaaaaaaagaaaatattcttttttggagataaaaaataaagattgaaatgttggcatcagtcttgtgtgtgttgggtggtcagctttcagtagtacacatagaattgtttaaaacagcatcccatatgtggattttttaatgaaaatatgaattatacattaggtacacatgtatcaagtcctctgggtgccagcattgtgagccaatccctagtaatcggtttgtaaataccacgtaggttcagtgttctgtgtctcagttgtgactttggctccagttacttgctgagcattttttccccaagaggtaatgctaaaaataagtactaaattattttaaatgcttttgctggctttgactagttatgacccatgtgctaaagtttctgtcttccattttacaacataatataagttcaaaggcattgactagagaggcagcattttattcaatcttaagaagataaaatattttgttctccatacatccagagtttcttacaaatgaataccttctagaaataagaaataagaaatttgagagtgttgtggcatgcacttttgtcccacttgaatattttcttctaaaattctgcacagaggtcgcatgaactgaaattgaggaagagcacagtatgagtctacaaagcctccgagaagatccacttatgtttcagtgtggctgcaggaacataaaggaagcatttttcccatagcacttcttatatacctctttctcccctctgattcccacctttttctcccccaggattatggaatgtgggagcgtggagataagactaatcagggcatcccggaattgaatgcaagctccgtaggaatggccaaggtgacagttgtcctgtttgttcttccttctgcatgtttttactgctttgatttggttcccttcatcaggagtttgtatttaatctgattagcatatttgtcaaaagtcagcatcaaggatgtgaaattcaagtggcacagttaccccagccacctgaaattctaggtaaagaaggtaggtttccaatgctgaaatctgcccatggcagaaagtaagagtgctccgtcctggttagctgctgccatcacccatgggtctaagctcttgctgttgtttaagaagctgcacgtgtgatgtccagtcttcttttctgggtcacagagaggactggagaatatcaccactttgtaggttggactcacaagttcaaaagtctacaaggtcagtcaaataacagtacgaagtgaaactagccagacagcaaggtgggggtcaggggaggaattggggacactgggaaactttccctgaaggtactctgattcaaactcatttaaaatactcttcaagccaaacaaaacacacctatggggcagattcgatctgtgggtcaccagtttgcttctcttgccatagacatatggtgtgcctccttccctccctcctccagaatgtaatgtattttttggacagagtagagcctccagggctataatttttaaagcaacaaaaaatatgctctattgaagtaaacagacagaaagtgtacttattactaaaagaattaactttctgaagtgccagatgtttgaagttaactgttaaaacatgtgagagaaaagacgaccatgaatttagtgcacacacacccacacacacacacacaacgttatgaacttgttaattcatttttaggtagaacactaacttcacttgggaaaatgtttttctgttttctctttcttgtttccataatgagcagcaatgtacaggagagctctgatccactgaaaataagaatagggtcgggcacagtggttcacgcctgtgatcccagcactttgggaggccgagatgggaggatcacctgagcccgggagttcaagaccagccctggcaaaatggcgagaccctgtctctacaaaaaaaaagaaaagaaaagaataaaaaagactagaacatgactacaggagtctagctggatttttaaaatgtgtttcattacctttgggaaaacatgtatactagattgcttaatgaaaaaggaacaccagatattggagtgtatgtttattagaaagaaaaagtaactcatacctgtgtttgtaggcagctcttgaggcaattgatgaactggacctttttggagcccatggaggacgcaagtcagtgattcatgttctgccagatgaggtcgagcactgccaggtaatagcctcttgcatttcagagagcagggaaggagagtcctggcatggaaggcctgggatccagtgcagattccccaccttgctggcttggtgatactttgcttctttgagcttcagttttctcacccataaaatgggcatcctggaccctctggcctcacaagctagttgtaagaatcagtcaacttagtctgtctaagcactttgtaagccagaaaagtataagacaccatgatgctgtatagatggaatcagcaatccaagcagccttgttttgcaagaggcaaagtctgttttatgtcttttgagcacatagatggttttctttcaggtttagttcacagtgcccccaaattgaatgatgagcaagcactagttcacttgggggtgaggggttggggatgggtgaaataggtagtggagaagaaatgagatgggaaagatgggaaattagtacaacctctgtgaaatacaggtcagagaaaggagtgatctaatacagattggaggattctattgagcagagtgcacgtcatcaattgctaggccctcagcaaactcttatttagcgagggcccgctgtgtgccaagtacgttgctggggctaaagaaggtcagatacataaagacttgtgaatggagagctttggtagaagtttgtgtttccaggcagagaaaccctagggaagagtgagttacagaacagggccctgggctcagttggctatagaaaataaagctttattctgaagctgaagggttccacccatcttgaccctatcttccagctcactcaatttttcccctttaggtagtcccggtatttcttggggtatagtctattttttttttttttttttaagaggaggtcttactctatcgcctaggctggagtgcagtggtgcaatcatagctccctgtaacctcaaactactgggctcaagcagtcctcccgcctcagcttcccaagtagctaggactacaggcacgtgtcacccacacccagctaatttttttttaatttttttgtaaagtcagggtctcactctgttgcccaggctgttctccaattcctggcctcaagtgatcttcccacctcagcctcccaaagctctggggttgcaggcatgagccactgtgcctggacgtggtgtgcatcttaatagatgtgtaatccagtggaaatgcgtgagctttgcagccagctgggcctgagttagaatcctagttctgtcacttactagctgctcgaagtctcagggtcctcaggtgtgaattggacatggtaccctaagtccttcttcatatgaaagattcaatgagcttatgtttgcaggggtctagccccatgtctgtacgtgttagatctcagtgttaattccttcctttcccaaacttttcctgataatttcaactcctttacaagtttccagcgcctaatccagccacttatttataattgaggccatattatagtgcctctaagtaaccctagaaagattctaggactaaactaattctgtggtttaccattttgtctgagtgttcatgagatcttctggatttgactcctcctttaagtggtttctggatcacccagtccaactggtcacattccacagaagccagacatttctccaagctggccccatgtatgtgttcttttctggtctctgtcttcatagccaagacagcttagcctactgacacaggtggccctatagttcctcccctacatgtcctaaaggtctggcaaagtcaatagggcatggaaggaagggagacaagcagttcttagcgtgggcttcagacagtaccatgctctccccaagccctgacttctcgcctgaggaataggaatcattggctggatatacagtgttggccagcaggggccatgttggtaggacaaagctctactcaaaattggcaaccgtattcgaatgttcccttggggccgagctcatggtccctagatactgcgcctattagcgcatctccaggttaaaccacctctttgtttttcattcagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggtaagcattagtcatgctggtgcccttctgtcctgtgtgatgtgcatggagcagctcacccatgcctcagttccccatgaggttaattgcttgatttatctaagcagatgcatacagcgttcaaagctgagtctacaggcaagaaaacaaagtctccgagtgatttagtggcttggttctctccttgagaagcagaactggcactcaggcaggcacctttgaaccccagtttgtaccagtaccatacttctaaggcagagctacttaaccctttagaggtcacagacagtgtatagagtcactgccagaaaaaaaaatgcatatgtcccaatatcctcaaactttacacacaatttcaatggacttgccaatcccaaagttaccttcaggttaaaataatccctgttttgaggtgaaatgcagtaaccgtgatacactaaactgagaatattaaatactccagccagttgaaactatcggtaaaattatcaaagaatgtaagtttccctaagctgaaatctgcagattgattgtcctacttaggttccatgaaaaatgcttttgtcccttggagtccctatgtctccaatcatattcccaaaagaaagcagctgtctcagtcagggttcagtgggaaaaagggaacccctttaggtagttgaagtaggaagggaatgaatacagagaatgaagtgtttacaagaagagcgggttctaggctcagcctcctgggatgactcccaggacagtgcggtgctggtcgctagggctagggacgtggttgcctccatgaccctcgcgagagccacatctgctgtagcagcctccacatacttacggaactggagaatggacacccaaagctgtgatctatggattaagggcgtcagattaagagagtgctgcccctgccctcctttcgtagcatccaggaagctggggcagaaccctggagcctgcagcccaaaaccagcagcgacagtcctaagcacaggaagctgccccctccctttctgctaatctttgtggaggtgcatctgaccttagagcctcctctgcagccaaagcctaacttccaggagcctggggaatgtccttgcagctttccaatcttgcaagtaggagcaaaccaatccaagtatctgccttggtggcttttctaaatagtgagggtccttttaggtctctgtgtaatacagtaaatcagaatgaaggcatggtcgttcactgaactcttggtaataactcttgcagccctgatactctgatggaatgttttggcgttcccttccaagtaccgatcaaacctgaattgattttgcttattacttaaatatattaataactatactgacagcaaagaacacttggtataaaattcattactaaaagattcatgggaaagagggtgcagggctgacttgaattaaaaaggcaaaaaaatttctctgagctcatcgaatgtactttctcttattaggggcgttatggatgctgtcgcttccttcgagatggttataaaactccaagagaggttgtatttaaatattgtttcttatctttcctcaactgtttcatctctaagttgccaatgtgttgttctccctctgctgattataattttatgttggaatattggaaagggaagtattaattttggagtcagcaagcctggagccaggcaatagcatagtatctttagtagggacggtgagctggtcatttaaaaccagcttggccaggcgcggtggctcacgcctgtaatcccagcactttgggaggccaaggtgggcggatcacgaggtcaggagatcgagaccatcccggctaacacagtgaaaccccatctctactaaaaatacaaaaaattagccgggtgtggtggcgggcacctgtagtcccagctactcagaaggctgaggcaggagaaaggcgtgaacccgggaggcggagcttgcactgagccgaaatcgcgccactgcactccagcctgggtgacagaatgagactccgtctcaaaaacaaaaacaaaaacaaaaaaccaacttgtaggccaggtgcagtggcctgtaatcccaacacttggggaggctgaggagggaggattgcttgagcccaggagttcgagaccagtctgggcaacatagtgagaccttgtctctacaaaaaaaataaaataaaattagtgaggcaggtgtgatggcatgtacctgtggtcctagcaactcaggaggctgaggtggtaggatcacttgagcccaggaggtcaaggctgcaatgagcagagatcacaccattgtactacagcctgggtgacagagtgagaccctgtctcaaaaaaataaaaatttctttaaaattttaaaaataaataaaaccagcttgtagacaaggagaactggttctgtggctcacacatttttcttaaagaccgactgtggcctcctcctcgggtttctttgccacactgactaatataatgatataaatcagatcctctgccaaacttggtggtagacatattgctatttctttgttagagttataggaagctttagtataataaactaccaaggagtcttgtgtatgtttctgacttactttctgaaatattaccatggcaaactgccaaaaacagcatctcattatagtaaaatcctactcatgccaacttcaaagctgtaaaaatcagtcaagcatgggaaaccccatgaggcacaatggtattatgtatgtattctgacatcaccttttaaaagtttgacttatttgattctaggaccctaatcgactgcattatgaccctgctgaactcaagctcttcgaaaacattgaatgtgagtggcctgtgttttggacatattttataatagatggagtcttcagtggtgatgctgttcaggtgagaaaatgctgggtgttacgttgataattattttcattccactggtatactgattattattagaacatagggttatgcaagaatttaggtcactgtttcggttatctgttcccacttagcaaactttcccaaaactgagtgaattaaagcaacacctattttatttatttgctcatgattctgcaatttgggcagagcccagcagggacaggttgtctctgctttacctgctgtcagctgggatggttccatggaagtggagaatctatttccaagatggcctcactcacatggccaattgatgctggctagcagctgatgctgggaactcagctgtgctattggtgggggccttggttctcctccacatggctagcttgggcttctcacaatattgtagtctctgggccattaattttacatgttggttgttttcccctcagaacacaaaagcagaagctgccaagcttccataagtgttaggcccggaactgacaaaatgtcactttcatcacattctgttggctaaaggaccatcccatattcaagcgggaggggactagacaagggcatgagtactaggaggcgtggttcactggggtctagcaagaacattccatcacagacaggttttgttgttgctgttgttctttccagatcagccagtggtttgctgtctttagccctagtttggggtgctcttggataacatcttacttcatgtaacagcctcctcactcgaatctcagcctccggcctggttccctgctgtttccattcttctcacccatgccagagtgatcttattaaaaggcaaattaggttatgctactgccttgcttgaaagcttgcttgaaaaccacttcatgcgttttgtggggttccatatgatctgatccctgctttcacccctgtagcctcatttcttagtgcttctttcttgagttctgtgatccaagcacaatgaaatcctttcagtcctttaaacaggccatgtgccctcctctcttctcaaaggccgaggacattcttttcttccccaattgcccctcccccttcccttggttcaatgtaagtgtgtcttctttcagaaagctttctctgaccctaaaagctggggcaggtgctcctacgacccacaactataacagcatgggtcacactatgttgtatctcccccttacctgtcaaaggacgctggtagaggccatctctctccagttcacgggtatagtccctgtgcctagtgcatagtatgtgctcagtaaacatttactgatgcaactctcatttgttcatgacctatctctttagcttctacttggtaccatgctctgtgctgagccctgagcatactttgttgaacagaaccgacctgtctttgtgcaggttacatgaatgactgacatcgcagatgctttgccattttttcaactggttctgatcacatgtttggtgggggtggggatgagcaatcagagattcactttagctcttgacagctctcctgctcaggaatgctggggggcttcagaaccagcagtcagctggaaatgttaatatttccccactgttgatgctttctcttaggcttcagtgattatcttaggttttctgtcattttatcccagaattgaaagatctcaaaagaattgacttagaatttcagttgtgaataggcttaacaatgatggggggaagaaaactcaggagaggaaaatgactgtgtttagcgtcttgttgattaagcttcatggaatctactacccttctacacctttgctgtcgctcacacttgttgcccaatgacatttttaatatggggtcaacttttttagcgcccacacatgagtgagaacatgtggcatctttctgtgcctggcttatttcacttaacacactgacctccaattccatccatgttactacaaatgacagaatgttattctttttttatggctgaatagtaatgaatgcctcttaagtggaaaacttaccaagaggtggaaatgggtacactgcttaagatatagcttcccccacaagaagtttataatccggttactgagacaaaatttaaatatatgaggggttaagaatgaaataattacatgacgagttaaagacagaacaggaaagacatctgatacacagtgtagatatgactactagaggaattttgaggaagaaacagctactgtatgatgggtgctctgtctctctttctggaagcaagacaggcagggctgagcttagatacactcctgagaggaatagccgatcgtgtttagctcctcctaacactgtaagtgtgcctcctgcactcctggagctgagggtatttgtgcatttctttgccctgtgtctgaactctaatctgttgccatgagagctttttttctatgttgcaccgctgttacagcaatcatgaccagacctccttcctgccatggatgatggggctgttttccaggtccaagaataccgagaggccctggagggaatactcatcagaggcaagaatgggatccgcctggtgcctgaactctacgctgtcccgcctaacaaggtaacccagtggcagagggccctttgcaccgcttatctagaaataagtgactcattgcttggcctgttggtattctttatcccctttttcgaactaatgaacactttttctccaaacatggtttcaaaagccttaggtaggctgggcgcggtggctcacgcctgtaatcccagcactttgggaggctgaggcgggtggattacttgtggtcaggagtttgagaccagcctggctgacatggcaaaaccccatctctactaaaaaaaaaaaaaaaaaatacaaaaattagccaggcatggtggcacatgcctgcagtcccagctacttgggaggctgaggcaggagaattgcttgaacctgggaggtggaggttgcaatgagccgagatcacaccactgcactttagcctgggctacagaacgagactccatctcaaaaaaaaaaaagccttaggtagtgttcctgtctatcccaaggaatcatgactttggaaaaatatgtggaacacgcttgaccatgggtatcctggggaggcagcagttgaagaccttcaaatgatacctgtccctccccgaaccctgacacaggctctctaaagagcgtaaacccattgtgcaccgtgttcttacacacttccacagacgaaggccaatgtacaggggtattgagaatctcttcctttgattcaagcagtttgcaagctagagtttgagtaatcacttagaagccattctacatcagggagagaaaaacagtccagttccaagaaaatgcccaaacatagttttattctatcaagtttcctaaattgggtcatgatggacctattatcttggcaggaagatttgtctgtcaatatctcatggttagaagaagaattcttggttcctggctgtcccttggatgcttttggtgcctcagggcttgattattgtgtttgtgggatgaaaaggccttcagaggaccgtgtcttccccaaaatcgccagggcctggaggaggttgtaagccagcagaggcctggcatatggcaacttgggtttaggtgttctgtggttcaatcaggcccacacacacatggccacaggactggcagggccttttaaagtgtctgcctcagctcagagaggctgtggaacctgtcagagctcacacagcactgggctccgccctggggccagaccccaggttcagggccttgctgccaccccacactgcctcctaatgggtggtacatttctgtgtgatggaagtatctacacagtggatgctctcactaggcttctgaaagcaatagtatagtggacttctttacttttccatagaatataaattttaaagcaatctgatacttgatccttatggcaaaaaaggtaccaccgtgtatcactttgagccttattttcatctaaaaggaactattacgtgttagatcactgaaccagttaaaccaagtagaaaatcaaaggaaggagtttccgtgagaagtagaatgtgccattgccggaagcattcagttttttgcatttatatcagcccatcttgttcactgggccccttgaggtggctgcttgctccaggtgggctcaccaagccccaccagcctggacccttagccctgagctccggaatgttgatggcccctcatcccaacatgaaccgacagcccacatcatccaagctctctcaggactgattttgttccagggttaagggccagactttggagaggaactagtcttccctcactctgcagatcagtctacggagcctgctagggctgtgttccttctaagtgtcctcagcctagatcccctgcaaataaatgtattccttttagtacgcgtgctgcggtatgtgggttggggcagggctggcagtgggggctgggttaccttccagcagctacatgttcatatcccgcttcaggtcgctcctttcccagtactgaggcattcgggaaaaccgaattggtaatgagaggtaatttggaacctggaagcagagcaagggaaaataagtgccttcaggggtattttacttattctatggtagagaagagccgtccagttctactagagggcacgttttactgactatagtaaatgccaggtgttaagagctacgcttttctttctttctgatgaacagtgctgactacacattgtaaaaaattactctgtgactttctgtcttctaaactccacactgacctttgggtttctgcttgtcattacaatgtcctcagcatgtttacactggtgtgctaggcactgattttgcacactctttgacactgattgcattttgtgttggctccttccagatgacagctgggaaggtttatcagtcacatcaataacatgtagagaccaccaggaaggatttctgcacacagggccaccacaggcccatgtggcacctgtgtgcaaattagataaaaggcctcatcagggtagccgcagccctgggccagggtggcatgcagcttggatgtgagccccactcatttcctcagccagatgtgcttgtgcagggcaccataaggccctctgtggacagctggagaccaatgaaagtgtccccgcaaacatggattgagcagccactccgtgccaggcaccaggctagctactggggcacaagggtggctacagcgccagctctgtccctgtgagcttgcaggttagcaggggccagacgagctggtccatgagatggagggcagtggcagcagcaaaagcatagcacctttgaggacctgtgggcagttcagaaggaccggtgtgcagagaggcagagggggatgcctccatgcggggcaggaggtggctcatgggtgggaggagtgcaaagccaggctgtcttgtaaactggacaccttgtctgctctctattgaatatttctcattctacatctctgcagtcttttttttttttttgagacagagtctcactctgtcacccaggctggagtgcattggcacaatcttgtctcactgcaacctctgcctctcaggttcacgtgattctcctgcctcagcctcctgagtagctgggattacaggcatttgccaccatgcctgactaatttttgtatttttagtagagacagggtttcgctgtgttggccagactggtctcgaactcctggcctcaggtgatctgcccacctcagcctcccaaagtgctgggattacaggtgtgagccaccatgcctgacctttcagtctttcttaacacgacttacatttcaaatagttttaacatactacctgattatcatacaagtaattctgtgcacgacaaaacatctaggattctgtagaaagaagaaaacgttatctctaattctaccacccaaagattatgacattttggagaatctccttccacactattgtcctattggattatttgattactaatgacatttaattctgttcagttcatgcactaaagtttttcttattgaaaaaattttaaattttactaaatatgttaataacatcattgattaatctgcaagcagaagatgagtctcctcatggtgtgatgttccccttgggagaaggatgtttcctatttcctttggttgacttacgttttctggaagacaaaagcggtcactgacattacccccaaccaatgatgtgatgactgaaatgtcaaagtccagcatggagtttaaaagagagaaagttgcagactagcttacaatgcgcagccagccctgtcctccagaaagaacaccaaagtttattttgctgagacagaagccccccagtgggttcagctttttgaggccctgaaggaggggttacaggctagtagtccaagtgtttttcctcggtaaatagtgccaccttctggcaattctcttgcattaggcgcacagtttataaacccctagggatggctccagcgatgcaccgccacagctggaggctgatgttttccatcatttcacccatcatgcagccaattgtaagcatgagccatgagagttctcatggccagagctgtgcgcaaagcaggcaggccaggcatccggtgctcgtggccttgcgtgtgcctgtaggaagagtgcttgtccagaaccaggccgcgatttgacttccacctccgctgctttgtagccttgcagccccgaggaaggggcttgctccccagcctcctggcacctgcacagaattggcctggaggatgagtaccatttcataaatcctcagtgcattccccatggtcaggtatcatggccattttatcctctgactttctgactttggatttgtctctctttccaggtagatgaagagtacaagaatcctcacacagtagaccgagttcctatggggaaggtgcctcatctgtggggccaatccttgtacatcctcagctcgctgttggcagaggtaggggcttagtggcctcacagactggaaaccatgtgattggaggttcagggaaccccagaagggcatagggactctctgccaggcgtgcgtgtggatgtcttttgcatcttcattcgtttaaggtcaactggaccgtgttggctccggggcttgactctcagccttgtgtgtccatatttccattaaaccagctcaggtccatgagggcccagcactccccatcaccccctgccagcattcttcctctgtggctagaatctgttccagttgatggtcagaggagctggaagtttctgggccaggattgttagcacatctgatcctagaagatacaagatttgggaaatgactagattggcccctaggtgcccctgccccagtcttaggagcaggaagcacaagggccacagatctctacagaaagaggtggcgggccggattttctctggtgaattttgtgtcaggtgttgccccggacaacctgcagcacccttccttctgcagacaactgcctcttgacacctttctttttgttcaccattgacttgtccccaggcttttgttttaatatgcaaatactttggagccgcctcaaatgaatcccccactcctcagtatgagtgaccttatcagatgggctgtcgttcctgagagggtcctgcccagctgagtgcttcggctggaccccggggaggcagggaggggaaggagcccagggaagggctgaggggctgccaggctctagaaaaggcagaaggggtggtgggtcagcatgccaccgggttcctagagtgttgaagcccaggatgaaagataccaccgtggaagcagccctcaggaacactacctgccgagctgaaacagttgttttacaggtacctcaagactccccagtgtcatggtcatgtccttggagtaggggctgtgtcttccactcctgtctttattagtagggaaaacgcatatatctcctttgaaagccagccctgtctctcactagttctctgatcccgggcaggtctctaatctctgggcttcggtttcctcatctgtaaaatgaaaaggatggacttgatcatctctgaccttccagctctgatttctgtatcagtgagatgggaaacgagtaactcccctcccctgctttctcctctctgatgtaaaggctttctctgggcccagcgctaggtccagttgctcctcagaactcccagaacaccttgatcctctctctcggggttcgtgtcatttgtagaaagtgcaaggaggtgcatattcaaagagaatactttgcaagggagtggggttgtgggggccaagtccccactcagccacttcccttgggtcattatcttggtttccccacctgtacagtggtgatggtggtagcgtgggggccaaggtgttctcctaaaggtctgatgaaaaatcactgacatgaggcagattgattaataagaaaaaagggcatgcagatatacttaacatgtatacaggggagccttcagaatgaataccccaagatctaggggaaattttctgtttttatgcatagtttcaacaaaatatggacagctgtgtagaaatgtgattagacaaaaggggcctgatgaatgctaatggaccaagtggggaaacccagcgaggcctttctgtgcagcgctctttccttctgagtgtggggcaggtccctccctagagtggggcccttatgacctacagccaaacaaggtaggtgagggaattttttatggccagtttttacagagaatatttgtaggttttgtggctggctttggggaaaagggattctggtttctatgcccaccttggggaagaagaattctagtttctgtggcgcctccagaagaatggactgagagagagaggcaggagaaggtcagaggaaaacttatgcttctgaggctgctgctgaggtctttgttttgggggtgttgttttctgagccccaaaagtagtgcctacctgtcaggaggcataaatatgacagtgcgcatacagtggctcaacacaatgcctggcatgttactgtgagctcagaaagtattggttatcattctttttgctcatacaagatggtggcatattcgacgagccctagagagctaggtgcaaaaatgtaatacgtttatcagtggcagtttgaatgatgttactctgtttcacagaaaataagcaattgactcgaaaaatataaagaaaaaagtcttgaatatgttgagccccaaaatatttcattttcacacttcagtttaagatgaaattttagttaatcaatatttcatagtgttaatgctcctcttttcatagggattccttgccgctggtgaaatcgatcccttaaatagaagattttccacttcagtcaaacctgatgttgtagtacaaggtttgtgagcgtgtttactgttcatatttaactttgtaaaaccaatgttattttaattcaaattgttgcctagtttcttatttaatttttttaaagtgtgtatgtgcctatgctttagcatgtagcagttgtgtgagatgccttatataactcagtggcttccaaaggcaacagaattcttcccaaccacaaaatgactttctacaaagcaattgttgtcttgaatataaaccttgattgcaactggggcacaagtgattcgttgcgcgtcatttatcatcattgttattctttgaaaaatagagcctaagcctggtgaaaactcagaacccaactgagggtcattcattcctcccttggagtcctgacatctttccgcctttcacctgtgtccacctttcctctccctcctctccagccagcccttcttctggagaggggcgagaccagcccaggctgctgctgccctccgcctagccaagtgatttcacccttctgtgcctcagggtcatcaggacttgagctccctgactggggcttcctaagatgtactgaggctgcagtgggaaagcgcttggtgtagtgcctggcctgtggtgtgcacccgggtggagcagttctcttcctaccttccttcttagggaggacctcctggcagtccagtaacattctctgtgccccatagagcacaccagctagtgtcatagcatgttgtgtgtacaccatattgcccctgagactgtacacttcttaatgacaaggcctatatcattcttgcagtttctatgttgattggcacatacgcacccatacgttgaaaacagtgattgaacaaatgacaagcatttctctgtagccactggctcattttgcttcgggggctcatgctgtggtgagatgagctgatatcacccagtcaatagagccatgagatacacctgtcacagcattctgattaggtaaagtttgagatgatgatcatcatctccaccttacacacgaggcttagaagttaacccactccctcaaggacccacagctggcagctgtaggtgtgaatccattcctgacttccaggtggactgatccagctggactcattgtgcctgcgctaagccagagcatgtcctgctaattagtcccttgaatctattaagaccgtttttccacctgcaggctgggacactttgatgggtgttgaccagcatttgtttaatagaacagtgtagaaattcccagaaggtcaggcacagagtaggggaagtgcagtttcagaaacttagccacatccagctgcacagatcatgaggctcccaggtctcccccaaaaccactgcactaaaggagttactcctacagagagtggctgctggggttttgataaatgtggagtcatgcctgtcattggaagctttagaagagacaggtgttaaggaaagccacctagccagccctgcatggctgatgttcccatttgctgagggcctgggagattaggtttcagtccacgtgcagctgtaactggccagttgagcatgcaaggcttccctgggggcttgttgtgaaggtcagatgagataatggatattaaaatacttgaaaaggcatcaagtgctgtgtaaatataaagaggtgacactcaactctcaactgcatgtatatgtattgtacattccggccccactagcctgtgagtacaatgattgtacttaacagtagccaatcctgcgctgccctgagcctctgcagcttccagggggctcggccgcagctggacatggcaccaacctctctccctgtggccgtgctccccttttccagtcccatccctgtactccttccctttgccaaagcactgtcccttctcagaaaggccagcggtactagtacagcaggtgcagcctagccgatcccgggttgtccccggtgatggcctccctcctccatgggcccccaggtcccaggcacaatcagctccccgcctgctggagagccaggtgcccagcctctcccaccagagatggggcccaggccagccctggggtgctttttccccaccggtggggccctgtgcgggggttctgaatgggccaggctgctccactaccgccagcatccccactcacagacctactttgctttctctagagggaaggatgtcccctcagaacatcccctgccagcaggcgcccccatcttactcttctttcccccgtcctttgggagcaggggcacaggcttctggcatcccccaagtggagctgtttccactcctgaccctgcataaaaagggacaccaggcaggtttagaatagatgcagacccagagggaggcaagacattacttgagacggggcagtttggcttgggacttattgaggacaatttctagaagtctcctatcagactatcttgcacaatgaaggcacttgataaataggcgttgaggttgttgaggggtggcaaggacagaatggggaggagcagcaggacgaacactgtcatttccaaagccagtcattgcatggaagagcatgctgatgtgtatgtcaccaggcagaagagggcagtaaggaacacgtgtccatgtgaagagacaagagtcatgagctaacgctcattctgtgttcttgttcacagttactgttttggcagaaaacaatcacattaaggacttattgaggaaacacggggtgaacgtccagagtatcgcggacattcatccaattcaagtccagccgggccggattcttagtcacatatatgccaagcttggtaggtttggggaaattacctgggcctttttggcatgggggcatctcggttctagatttggggtctgagggagactgtgatatacgtaagttctaaagacttggacaaaaactaaagcaggcggttccaccgcttcgatgtgaagaggaacgggcaaaccagcacgttctcacacccgttcagtgggcaccgtcacaggtggccaagcattcgccggatctgttgtaaaataaggagccaccttgaaaaatttacaattggaaaagtcatttgtgtcttgataatgcttctcatgtttacctttagtatcagaaaatgctcatttacacattaaaatgggaggaggttctctatgctttttctacaatctgactttgtttactattatggttcaatactaagtaaatcgaaagtaaatgttctatagtccttttagtagttttattccatgcagttccaactgggtactgttcatatacattcatgaaaagaagggggcgggatttgttttaatattcagcttcgtgccattttaaaggatgatggcagtagaagaaccaagccccaaaatgggttgtctaatctagaaataagctcagtcttagcctgagttgcctggattacttgttaaccgtatttcctctaactccaatttatcttttacttctcaaacaggacggaataagaatatgaatttgagtgggcgaccgtatcgacatattggtgtccttggaacctctaaactatatgtgattaggaaccaaatctttacttttacaccccaggtgaggagagcaggccaacgagcatcttttttttaagttctctttgctgtctggtaagcttttctcctgtgaatatgacagaattctgcatgcataggttcaaatagagacatatgaaatgataccaagagcctagtacaagtctgcccgtagtaggtgctcggtaaatgctttttgagacaggcgtgccatcacttccagtcatgaatattagtgaaattcagactgctttagaagtttgctgttgacatgtcacttgactcacagcccttgtgcccctaatcacaatcatctctgacccttgtgcaagctgtcatcagaccctctgtgtaacacacagccaggctgattttctggccacaccctcgcttactgggatactgaatgtactcatggaacttactggagagctttggtttccaaagaaaactagtcctgtggaagtacatagaaaatatttttcacccatttgggcagctagaaagaccaacagtgggatcgctttggcagtgcagggcacaatccctgcttacctgggcacagggttggtcatggggtcttgggtcaagctgctgtttcatcctagcccctgctgctcacagaaagcttgtgagctatttcccttagtagcaaatttcagtccagagctgagcatgcactagtccagaggccaagagaacagtttgatttgttctcaacatcaggcagcagtgtctttagttgacattaaccaaagccatcaatcaggtaaacagagtgtccacctcccacctgctcacagtgcccccacttggaaagcatcttcgaacccatagccctggaaggatcaggaattaaggagttattgatttgctttcagagacagcagtgttgggcaagatgcttaaatccccatctgaggagctggaaataaatctagcagtgcacctttcccttccaccctacagcgacagctcccgggcaggcagcagactgatttgtctgatcttgagcagggcagccccatgactgggtggattgaaacgagtactgagcctcttgcctggcaataaaaccccaggattagtgctgacctgagttgtcagctggtgtttccaggtaaagaaagggtggccgtttacccagcctcctctgactttcagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcagtaactccagggatttcagcaggctccctcctgccccaggggtggtttgggctcttacaaatgtttaaaatggctcccatggccagaactaagcactgaaggggcttcttagcagtttggtttcttatctcgggaatcttctatgccagaaatattttaattagatggtgttgatgaaaatgtttcagtgcataacggaaaaaaagtctgcccagactaaactaattcatcactttttttccttagcaaatgatggctcagacattcattctgctgtgctctccacaattagaaaactagaggatggatattttggaggagccaggtaatttgtgatttttttaaaaaatataagagtagcactgacctttcttaaagtcctttgctgcccttgtcccatttttcatattaattgttgaacctaaaagcatgcagttttagagtaagcaggaaggtaacacttctctaatccagtcgcccgtgtgaaacttggctcatctctgaaacagcactcggctgatatcttttaagctttacaggcaccaggaggcctcggacatagggaggtgaaccatcaagtccctctgaaacatctgttcttcttggaacgcatgtatggaattctgtgtatatttctgttaaaaggtgtggaagaaaatactctgcctgggatcctgcaggtgcccaataaatgctccttgcaccaacttgaatatgctatcaccttaagattcatttgcaggacttggcaaattccttagagccctcacagcagagcacctgaatgagtctgtgtaggtcactggcccctcaccttctgtggaatgagcccccttctggtttacaggccccaagtagggaagacgtacccaggtattatgcttaagcaccttgagtgatagagggcttgccctccaggaataccccttccatttttgtgccctctactgtcacaaggcagaggtcttctctgtagtgtctattctctcatcttcttccatcccctaggatataccagaagggccccaagagaatgctgtggaccaggcacggtggctcacactataatcccagcactttgggaggctgaggcaggcagatcacctgaggtcagaagtttgagaccagcctggcaaaaccctgtctctattgaaaatacaaaaattagccaggcatggtggtgcacgcctgtagtcccagccatttgggaggctgaggcaggagaatcgcttgaacttaggaggtagaggctgcagtgagccaagatcataccactgcactccagcctgggtaacagaatgagactccgtctcaaaaaaaaaaaaaaaaaaaaggagaatctcactgtgtagctcagccctggtgtagcctttccagggctcagggaggcttctgtttggtccctgatggaattccagttgctaaaacttttggagttgaagcccaccctttcttctcacatcctctcaccccagggacactcctaccacagcaaagtcactgtcgtttttttaaaattatggtaatttacctataacattaccttaaccatttgtaagtgtatagttcagtagtgttaagtacattcacattgttgtgcaaccaatctccagaactcttttcattttgcaacaagtaaaactgtacacccattaatagcaactctacttccccctcctcccgcccctagcaaccaccagcctttctgcctccatgagtttgactgctccagatagctcatataagtggcatcatacaacatttatcattttgtgactggctcatttcacatgatgtccccaaagttaagtccctgttatttctaaccctggccttgagcgatttgaagagcccgctgaggttggtccctctgcccacagagcttcttgcaggttttgctgtagacttgaagtggcccttgatccaagcttctcctggcctttctcgcgagactgtccccagtgttttgctgtatacactttcaggactagtgccataccagcaatctgcatccacttttgcacattttacctccaatttgcttcagttaccacctggtgcatggcatcataactgagagagaataccaaaggcctataattaaccattttgcaaaataattttttttttttttgaaacggagtttcactcttgttgcccaggctggagtgcagtggcacaatctcggctcactgcaacctccaccccccaggttcaagcaattctcctgcctcggcctcccaggtagctgggatcacaggcatgtgccaccacacctggctaattttgtatttttagtagagacggggtttcaccatgttggccaggctggtctcaaactcctgacctcaggtgatccacctgcctcagcctcccaaagtgctgggattacaggtgtgagctactgtgcccagccgcaaaataaatccttttattgagatctaatcattgtaaaaaggaaattgtctgcagttcactgagcactggccgtgtattcaatgtgttgtctcattgaggcttcactttctgacttggggtgaattcccatttcatagacaaggagctgtagactcagagagccattggcagaagaggaataggtgcagcagctctgtgtgaacccagaacccggcctctaagccctggtgctgagctggatgagggcttattggtgtcaggagggccccttggttatagaccatggcagatgattcagagagccttagaagagactggaatgcctaggctacttctgctcagttcatgatcattaagagctttataaataaaattaatatagttataatttagtatatgatttatagattacatataggagttataactatgtaacacagtgttataaaaattatattgcaaagataattaagttcttgataagttgagtcacagttttggcttttcctctatttctgagggttgttgttgtttttcttttgagacggagtctctgtcgcccaggctggagtacagtggcgcgatctcggctcactgcaacctccacctcccaggttcaagcagttctgtctcagcctctcaagtacctgggattacagatgcctgccaccacaccctgctaatttttgtatttttagtagagaggggtttcaccatgttggccagggtggtctcaaactcctgagctcaggtgatccacctgccttggcctcccaaagtgctgggattgcaagcataaaccatggtgcccagcctatttctgagggttttttaaaagctgaactcaccctacatacccactggatccacttggggggggtgctcaattaaagaaaggcttttctttccctcgggctgtcattctggttatagcccttttgaggctgaagctctggcacctctgatactattgcattacatatgcctcaattgactctttaaacgtttctcagccttttcaactaaatcccaatctggtgctgataactctgagggagggatccattgctttctgctcccccggtgtaaccttttaagaatgttttcttctgtatgtgcaaatcgctcccagcgtgtggggttggacctgcagaacctcaggccccaggctgccaaacccagcgtccaggtttcagtggaactgtgcccagcctaaggtgatagggccactcagggcttctgctccagtctggggatggcttccccattgaattccttctagagggaacctgacctcttccatcatagcacccctgtccctgtgtgacagtgtttcgtggtagggactcataaataatggaacgagtgtgcccagagaatcactgcttctgggccagtcgttttgggggaaaaaacaaaacaaaaacatgggttggttctgtttaaaagtagtttgcgcaatatattttgtcaaactgttggttggttcagtaaaatagagtcgtatttgtgttgggttgggagtaagaagtcagtgtgattcatttggcttttaatatgctgtgcgcgttcacttcatacttgctattgaatttttgtttgaatgtcttggctgaccgcttatatggggcaatctgcagagtgatatatgtattgattctggcagaagcaccacatggttgtgcaaaagtctctcagtgattcatagtggaaggttatccacacactacctgtgtccctaacacggtgtcttcttggcagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaaggtacagcttggaatgcttttgtgggtagttcgctgaatttatttaaactttagcattgtgataaaattgccctaagactcaaatatagacaatgattgataattaaaaacaaggaaaaacaaaaaagaggcttctgaaacttgcatatattaaaatgaataaaatgcccgtttaaaaaccgaaactgcaaatgatgtccttgaaagtggggcatttttaaacctagaaggacaaagagtttcaggaatggggactttttttcttttttttcttctctctctctctttttttttttttttttttgttgttgtttgtttttgagacagggtcttgctctgttgcccaggctggagtgcagtggcatgatcatggctcactgcagcctcgacctcctgggctcaagcaatcctcccacctcagcctcccaagtggctaagactataggcctacagggaagcaccaccatacccagctaattcttttatattttatagagatggggtctccttatgttgccctggctggtcttaaactcctgggctcaactgatcagcctgcctcgtcctcccaaagtgctgggattacaggcatgagccaccgtggctggccaggaatggggactttgcacagaatacatacattctgaagacagaaacatactgcttgaattttcaaaggagtggtagaatgatctaggtttggttggatatgagtgatgaaaccctacgtatataacatttgtcagtctgaataaggttttgaggtgatctgtttttcacttttagatagtagttggaattagggctgggagttccataaggcttagctcactcatgacaaattaaaacaaaaagcccagacttcggctgctatccttcaggctgtcttacatattattcagttcatcttgggaggacgagatgtaaacactatcttgactggtagtttttttttcctgggataaagtttttccaaacagcaaatttctacacacatacattatctctgtaaatctcttcttactcttcaggggtgagtgggagtgcaaatatcgatatctcagtgttgtcatctgctaagcctactcagtgctgcttgctacccatggtcactattgtgtagtcatatttctacagcttggtttcattggctctttttcttgcttgtccaattacagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatgtatgttattaactcttttctgcctgttaaaataccttcttttatcaaagtaatgcagggacataatttaaaagccaaagaatcctagaagacaacaaaatgccccccacgtgcttctacttagaggtaaccactttcaactcttttagctctttcttctggtatgtacatatctccatatttctcaaataatgtgtacatactgctgtcttcacatgcattgacttgattcggtacttgttgactttcgattaagtgggtaaggatctggctgtcttaaatcaccactcctctgcttcactccccctaacccaccaaggggttaaagtttagttaaatcagtattcactctttatatcattgtatgtacacaaatatttccaactgagcattatagtatactctgtttatattcccatttttactctgttttttcgaaaggtaaagttaccctggcttttcatttgctttgctttctttctacatcttccagtggcctcgcaatacaaatttccacaagctcagtcgtatcggtgaatctctcaattccactgcctttcttagagtccacgagtctccttctatctgtgctgactgcgctctaggcctgttgcatatgtgtcatcctgggagtttccctggcttgtctccttagttggattccgtggttcctgaatctgctgtgttcccctttctcaatgtattcttctgttttggtggagcacattctagaatagtttcagtaggtttcaaaaaaaaaaaagtgaagtggaagagggcatggtggtgacagctctcgacttacttgtttttgaactgcactgccctctgcccccttctggcttggttgccctcagtgtctgaggtgctttttaccctgggatcttccccggaggcttccttgacttgtctcctgggatggctctcctgtgttctgtatcccaactcttctttcttggttcactcttattttaatagaggacatgcagtagtttcctgagaaacagcgcacggtgggtaaaattgttgaaaccttgccattttaaaaatgtctacaaatgttccagacccatttgagagtttggctgggtatagaattctagattaaaaatacatttttttggctgggcgtggtggctcatacctgtaatcccagcacttttggaagctgaggcaggcggatcacttgaggccaggactttgagactagcctggccaacatggtgaaacgctgtctgtactaaaaatacagaaatgagccaggtttggtggcctgcacctgtaatcccagctactcaggaggctgaggcagaagaagcacttgaacccgggaagcagaggttgcagtgagctgagatcgtgccactacactccagcctgggtgacagagcaagaccctgtctcaaaaaaaaaaaaaaaagacatttttttgcagatttttgaaagtatgacttattgtcttcttgctatcagtgtgttggtgttgctgttgagaaatctaaacctgggcaggcacagtggctcatgcctataatctgagcaatctgggaaactgaggcaggaagatcgcttgagtccaggaatttgagaccagcctgggcaagatagtgaggccctgtctctacaaaaaatagaaaaaatagccaggcatggtggcacatgcctgtagtcccagctacttgggagtctgaggcaggaggatcacttgagctcagggaggttgaggttgcagtgagctgtgatcacaccactgcactccagcctgagtaacagaacgagaacctgtctcaaaaaaaaaaaaaaatgtattagcccattcttgcattgccataaagaaatacctgagactgggtaatttataaagaaaagaggtctaattggctcagggttctgccggctgtacaggaagcatgatgctggcatctacttggcttctagggaggcctcaggaagcttccagtcatgacggaagacaaaaggggagcagacacttcacatggcgacagtaggaacaagagagagtggtcacacacttttgaacaaccagatctcatatcccttgtgaactcagagtgagagctcacttatcaccaaggggatggcccaagccattcatgagggacccacccccatgatccaaacacctcccaccaggccccacctccaacactggggattacatttcaacatgagatttgagtgagacattcaaaccatatcagaaattaaacccattctgattgtttgagacaagagtatcactctgtcgcccaggccagagtgcagtggctcgatctcagctcactgcaacctccgcctcctgggttcaagcgagcctcctgggttcaagcgattctcctgcctcagcctcccaagtagcggggattacaggcacccaccatcacatccggctaatttttgtatttttagtagagacagggtttcaccgtgttggccaggctggtcttgaacttctgacctcaggcaatctgccctcttgggcctcccaaagtgctgggattacaggcgtgagccaccgtgcccggctcattctgatttttgatacttcaaatatgagctgtttttctctttgaaagtgtttaggatcttctctgctcccggcttctgacatctcagtgctgcaccttaatctctatctgggtgtgttttcatccattgtgttggatacacactgggcctttccaatctggaaatttgtttttcagtcctgtaaagttttcctaaaaagtttcttgactcatttcctgcccaacattttctctgttctttctttctggtgttcctatgattccaaagttgacttcctagagaagactttatcatttttttccctctgttttccatttttctgtcttgtcctgaaagccattgtctcaactttttgttccatcccctcaatttagccacttttgctatcatgttttaaatctttgttccccaaattgtgtctgtttttgtttcacgtttacaatataatttcttggccagacgcagtggctgatgcctataatcccagcacattgggaggccaagacaggcggattccttgaacccaagaattctggaccagcctgggcaacgtagcaagacactgtctgtacaaaaaaaaaaaaaaaaaagattagccaggcgtggtggtgcatgtctgtgatcccaggtacttgggaggctgaggtgggaggatcgcatgagtccgggaggttgaggctgcagtgagccatgatcatgccactgcactccagcctgggtgacagagcgagaccctgtctcaaaaaaatagtaaaaatacagtataatttctttttctgaaagagagaaagaaaaggtcctgctctgtcacccaggctgaagtgcagtggcatgatcatggctcactgcagccttcacctcccaggcccaagcgatccccctacctcaacctcccaagtagctgggaccacaggtgcatgccaccacacccagctaatttttatttttatttctgtggagacagggtttcaccatgttgcccaggctggtctcaaactcctgacctcaaacgatctgcctgccgtggcttcccaaagtgctgggattacaggcatgagccaccatacctggcaatttgttattattctaagaatattaatggcagggctttttgttttggtttgtatataccctttttactctttgaatggtttccattcccccaagtcaccttttccggtttgcttaggtttctgtcttccacatgagcgtcctccttcaaatgccctgctcctcctcgcttacctggtcatgcatgagaatctccaagcccatgggtggggcttgttgactcggagttatttgatttcccagagatactctacaatctcctagtggatttcctatttcaaggattagggcctggttgcctggagctatatagttacttataattcccttaaggaatgtatctacgccttcagatgtgctaatcagcagcccctctctcttcgagccccttcctcctttaccctcttctgagagaccctccagtcttctgtcagagtgagtgaggtggtcatcaagctgggtgtagttgaagcggatgtccagggagctcactgcttctcagatagcttctccccagccttccttgttttggacaccccttctaggccccagttccagaagcacatagtgcagcaggccccagggacttctgatgagccttgggtgtaactgaccagctctcggatttctccactgcagacttgggaattggttgccttgtgtcagctaaatcacttatctttcatctgtcagctttcccgcttctgaaattctgttcctgtcgtcttctttcttgtttttcttcattctcaaggatttgtcttttaaaaaaaaatatatacagttatgcaccacataactttttggtcaatggcagaccgcatatatggcggtggtcccctaagattataatggagctgaaacctttctgtcacctagtgacatcgtagctgtagtgactttgtagcaccatgcactgctcacatgtttgtggcgatgccagtatcagtaaacctcctgcgctgccagtcgtgtacaggtctagcacatacaattatgtatagtacataatacttgataatacataagtatgttgctggtttgcgtatttagagtgtactccttttacttattaaaaaacgttaactgtgaaacagccgcagaccagttcttcaagagggattacaggagaaagcattgttatcttaggagatgacagctccatgtacattactgcccctgaagaccttccagtgggacaagctgtggaggtggaagcagtgatggatgatcctggccctgcataggcctaatgtgtgtgtttgtgttttcattttttaaaaaaagtttaaaaagtaaaataaataaaactaaaaaatagatcaaagcttatagaataaggacgtaaagaaaatatttttgtgggccggctgtggtggctcatgcctgtaatcccagcactttaggaggcccaggtgggtgggtcaggagttcaagaccagcctggctaacatggtgaaaccctgtctctactaaaaatacaaaaattagctgggcgtggaggcacacacctgtaatcccagctactcgggaggctgaggtgggagagtcgcttgaaccagggaggtggaggttgcagtgagccgagatcgcaccactgcagtccagcctgggcaacaaggcgagactccatctcaaaaaaaaaaaagaaagaaaatatttttgtacagctgtacgatctgtgttttaagctgttattacaaaagtcagatttttaaaaatttaagtttataaagttacagtaagctaaggtcatttaatattaaagaacactgtgtgatgaattcagtgcagtgtgaatgtagagtatttatgaagtctacagcagtgtacagtcatgtcctaggccttcacattcactcaccactcacccagtcacccagagcaacttccagtcctgcaagctccattcatggcaagggccctatagaggtgaaccatttttcatcttatataccatatttctctttttttttttttttttgacagggtcttgctctgtcacccaggctgaagtgcagtgccacgatcagggcttactgcagcctcagtctcctgagctcaagcgatccttctgcctcagccctccagtagctgggactacaggcatgcaccatcacacccggctcattgtttttgttttgttttttgagacagtttcattcttgttgccgaggctggagtgcaatggcatgatctcagctcaccataatcttcgcctcccaggttcaagcgattctcccgcctcagcctccggagtagctgggattacaggcatgtgccaccacacctggctaattttgtatttttagtagagatggggtttcgccatgttgtcaggctgatcttgaactcccgacctcaggtgatccttccgcctcagcctgccaaagtgctgggattacaggtgtgagccaccacgcctggcctaccatttttttttttttttaattttagtagggatgaggtctcactatgttgcccaggccagtcttgaactcctgagctcaagaaatcctctcacctcagcctcccaaagtgctgggattacaggcatgagccaccatgcctggcctataccatctttctaccataccttttctatgtttagacacacaaatactattgtgttacagttacctacagtattcagtacaggaacatggatacaggtttgtagcctaggagcaatagcctctatcatccaacctaggtgtgtagtaggctgtaccatctaggtttgtgtaagtacactctatgctgttcatgcagtgaggaatttgcctaatgacacatttctcagaatgtatccctgtcattaaacaatgcatgactgtatatattttctgtaatgttagtggagggttggaaggaattaaaattacagtgtgtattcaattcacaaatataacctggaggtctataaatgccttttaaatatgcatcatctttaccttgaaaacttcttgttctcctgagatgacatgatatagcctggaagacagggatggcttaatgaataaatatcaataatgataatatccagaggtggttgaaaaacaagccctactgcccagcagtggcagagtgaagtgcatactggaccggaagccaagacaccttggttatgggaagtgaccttggacaaatggtctgccctctctgggtctctcagtttcctcatccgaaagaaaaagaggtcaggcgaaatcacttctgagcttctttccagtcctgggatgttgtatcatttttcctgaattccaggagggaaaagcgaaatccagttctcaaagcaagatctatgcctgctcacttcttattcccagatttagcacatgaggtggctacatgataaattcttgttgaagctaaactaaataagtgatctttccttctgttggtttgtgttagataaggagcagccgccatacttctcaaaagaagtattggccgggaacggtggctcaagcctataatcccagcactttgggaggctgagacggctgtatcacctgaggtcaggagttcaagaccagcctgaccaacatggcaaaaccctgtctctactaaaaatataaaaattaggctgggcctagtggctcatgcctgtattcccagcactttgggaggctgaggtgggcagatcacctgaggtcgggagttcgagatcagcctgaccaacatggcgaaattccgtccctactaaagatacaaaattagccaggcgtggtggcacatgcctataatcccagctatttgggaggccgaggcaggagaatcacttgaacctgggaggtggaggttgcggtgagccaagatctcgccatcgcactccaacctgagcaacaagagggaaactctgtctcaaaaaaaaaaaaaaaaaattagctgggcgtggtggcacgtgcctgttatcccagctactcgggaggctgaggcaggagaatcgcttgaacccgggaggcaaaggttgcagtgaggcgagatcacaccagtgcactccagcctgggtgacagagtgagattctgtctcaaaaaaaaaaaaagtgttgttcttcctcctcagaataactctctttattcttttgttttccagttgttcccatgactttgccgactaaagttctaagtgcccaccgtaaatcactgaatcttgttgattctcctcagccactcctagaaaaggtaaagtatatggaacagctttttttaaaagtatggtgttctacaatgcaggatgagtccccaaactcttccaaatggctaaactcaaaagaaacagcatatttctcgatatcagggacctttcagtttagaagctctgggcttgggtgtgaacccaatcacttcgttgtctggaatctgacttgcatcaatatgtacattgaatttgatgcaaacctttacattttgcctgtagaaaaagctactaccttgctgcctactcatcagagtctatgtagccactagaggaaaaagctcactacctaaccccgcctaactgtttagccagccaaggtgggactacttggggaacagagtacaggactctttgttcctaatggcctttttaaatttttcttagagtctcgctctgtcacccaggctggagtgcagtggtgtgatcacagctcactgcagcctcaacctccaggctcaggcaatcctcccacctcagcttcccaaatagttgggactaccagcgtgcgccaccatgcccagctaatttttgtattttttgtagagacagggttttaccatgttgcccagactggtctggaattcctgggctcaagcgatcctctcaccttagcctcccaaagtgctgggattacaggcgcaagccactgcacctggctcctaatgctcttaatgtaagaaaaaacagtaaaagattccttaggatactgcaggaaaaagatgggcataaaaaaattttaaaaataagattgctcaggagaataaaatctcagcctgttccattaattcccacaatttgttattttatccaggactcttccctgattctaccccacacgaacagactcagtggcacactcagtgcctgttggagaagattttaccctgatttcaattttaggttgtttacatcctttttgcgtttgttttgcttccaaataactataccatatatgcagcatggtgcagaaagcaggaatagagaagcgagaggtcacctccaacccctccttagctcttgtgagggcttttcggctccgtctagaagccgcttgacaccaggcatctgcaagaaaaagcatacaaaggtgattagctgtctgggtacatggggatcttcacaagagagtgaagtctgaagaagtggtcaaagcaagatgctttcctactttttaaacaaagagtgataaatttgagaagctaggacaggacaaggaaaatctggctagaggcagttactaggagatatatacacagggtgtgtaaaactagtggaagataaggtttccttgggtaagtgtatttatacaggtccattgccgcccccagttcctgggctctggtgatatgggctattttcacgccctaggagtgtacccctcccagaggcatccttatggcttgctgcctgcagaaagagacaggtcagctacccctttctgaaactacaatttttccaatgttttcaactcaaaattgtcaatataccaatctggcatatttggggatagcacatccttcacaccttcagctcaatgaatgatcaccaagccagtatacctggatcaatgaccaccttctgtgcccccctcccatctctttctccttttctggtccagagataactgctgtcatgattcctaacaccagaggttagttctactggtctgtgaaccttccataaataaaactcacatatattttaacctattcagtccagtctcttgcaaatgttgaccagcacagtgattcactgatcaaaaatagtaaaagcctataaataaagaggtacaaaaagtcattgaaaactggagcacagcacagcaatagagttccaagaccagattggtgtttcacttcttgatcttccgaaagttccatgcctagcccatctccctgctttctggctcttgtatgaacaggttcctgaaagtgactttcagtggcccagagatgaccatggtgacgtggactgtgagaagctggttgagcagctaaaagattgttcgaacctacaggaccaagcagacattctgtacattctttatgtcataaagtaagtgtctgagtccattcgggcagttataacaaaataccatgaacagattggcttaggaacaacagaaatgaatttctcacagttccggaggctgggaagttgaaactcaaggccgatttgatgtctgggaaggcctgttttctcatagatggcatcttctcattgcatcctgacatggtggaaggggcgagtgagctctctggcattgtttttataagggcactcatttccttcaggagggctctgccctctgacctgatgacctcccaaagtccccacctcctaatgtcatcattgtgggggttaagatttcaacataggaattgggggaaaacagacattcaagccgtagcagtaagtttatggtctttactaggctaagctttctcagttctccttaattttttccgtagtattcttggccttctagccagcccaggtcatgattatattcaccccagttacccaggatcaccaggaatgagacttccatccccttctctgcctactgatgctggtcccccagcatgagaaggctatgtgaggccaggaggccaccacgtcctgatgttaggcttctgtttcaaaggacatagggaagctttggtcgggcgtaaccctctcagtgagactcaggggcactgggagagcccaagtgctgtgcaaaatgcacagtgatccattcctctcccagtctaaactttctggaccatatttctgggtttttctacctcttggcaggggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggtcagtgcgactgtgcaggctgcccatgtgtgctcactagctcgtgcccccttcctcttccacttccaatctcccagttatacctcttacttgtgaaggagccccattctttaacccacaggtggagcgggcccttctctcctgcctgcctgctgctccaggaaggcgagcagagggaaggaaatgcaagtggattggttttgttctttcttggctacggaaaaagtctcgccaggaaatcaaatgaaagtgctctgtggcctggcagcctcttagagctctctttttttcacacatccacagtacagtgatcattaatatttataaccccaaggccaggcaaaatccagagctgctttctaagacactcgagttcagtgtcatgatggtaagatgatggcatttattagatgtgaataatggggaaacgggtaacttaggaattgaatatggttattaactcttaccatcggtatcttcggactcatccctgtctcactcaatagcagggagtccaatgtgtttgctagtggatgggcattaaacgcccactgacgggcccttcggagccaggcttggggccacacattggagacagagaccacagacacccatccctgtctgggttgcttagtctggggtctaggtatgaatttttcagatcaagggcaacatgggtcactaagtttgtaaaggtaaatgtacgatctgattggcagtgtctcctccccactgcctgtctgtcgtctttgccagtatctctctcgcgctctgcctctcacccttccccttaactgcgcaggcctgcacagacctgctttcgcaccagaagcagctcaccgtgggcctgccgcccgagccccgggagaagatcatctctgcgtaagtcctcagccttggggacctcaggtttgcgggggagccatggggaaaacagcgcttcccagtgttcggaggaggggctttttaaagacactctgtcacatggatgcgtctagcacagaaaataagggtgttccatggagggcgaggaggcactgtctcaagacacctcatcacattcgtgacacaatgctcctttctaggccccttcccccagaggagctcacaaaactcatctacgaggccagtgggcaggacatcagcattgccgtcctcacgcaggtctggggctggtgtgggaggggtcgggccacagccttcctcagagtggaggggacccttcagccactcaccctgtctctgaaaccctatctccgtgtgtgtctgcctcaggagattgtggtttacctggccatgtatgtcagggcgcagcccagcctctttgtggagatgctgagactccggattggactgatcattcaggtgatggccacggagctggcacggagcctgaactgctcaggtgagatgcccgcagctcctgcagctcccgccgcaccccaccccaaccacccggccacggcctccactctcaggggaagaactgcttaggttatctcgaacccagcatccaagcctgtggcaagctcaggccttaccagcttctctcatttagatggaactcccatccatgcggcatagagctgaagttcataagtcagggagaatggggctctggtgatgtttaccattatagcctcaaaggcgatgtggaatcttccgccctgtacccgacatctaagctccttcctggatgcccttgctatgagatgtcacccccattttataacaccttcactgggagaaaccctaccaatttgaatataaaaatccatcatgagacatccaacgttggggatcatacattgtgaaacatcatgtgtctaagaattaagcagatacatgatttaaacggcagcatttagaatccccacggaacagtgcatttcagccccaaagcaatagtgaggttctcctgaacagggggacctgccatggcatctgctatcacctccctccccacccacgtccacctgaccctacctttacccgccaccagccctgtgtttgggacacttacaagatatttgtttttaggagaagaggcttctgaaagtttgatgaacctcagccctttcgatatgaaaaatctcctgcaccatattctaagtgggaaagagtttggcgttgaaagaagtggtaagttccatgctcctgttaacgtcttcagggagctgcctcctttacatgcagcagacattagaaccagcactgtggggcatagcgaatgtgggaagagaaggctcctacctgaaggagatggacagagtcctaggctcaagcttcctgctttgggggctttgagacttgctcgcagtgtgctgggcgagcttttcttgcccaggttggcacagcatgtgggtgtggtataccgcctcctgtagtcgtaagcacctggcaccatcacttacgcaaaagtgttggctgggctcggtggctaacgcctgtaatcccagcactttgggaggctgaggtgggcggatgacgaggtcaggagtttgagaccagcctgaccaacgtggtgaaaccccgtcactactaaaaatacaaaaaaaattagtcaggcgtggtggcgcgcgcctgtaatcccaggtactcaggaggctgaggcaggagaattgcttcaacccgggaggtggaggttacagtgagctgagatcgcgccactgcgctccagcctgggcgacagagcaaaactctgttctcaaaaaaaagtgttagaagtgtgggggaccccgaatgccagggtgaaagggctgtcctttcacaccacctgagcatcctgccctttggtttgggtaaaaacattctcaacccggcctcacatcaccctccacagggcagggaggagacccctctgtgacctcagcatgctcgagctaacttattttgctttgtcctgcctcgctcactctgtttttatctgaaccggaaccctgcttgcagtgctgggaaacataatcacccaagtcctggcgtgattcttgttctcaaatgttccctaattataattgaagcaattatcatttctcctcctcataaaaaagctaaatgatttgcaggcacgttggtgaatttatttcatcaagccaaagaaatgcactgtgggctatcattcctttattatttaataagaaggacattgggtactttgtatgtttcctgagcatgtgctggctgcaaacaaagacagcatcgtgcagtcagatgtgttttggtggtttttctcctttcccgaaggaggggtgctcagaatgcttttgcaaaagtaatttccagttctttccaaggcagagtccttgaaatggtaatgtacgagataaatatttaatgtgttctgctcatcattatagtattcatggcttgacacagataattactaaaaatttgtcattagatgtacagctatagatgctatgaaactaggaactgagtaatgtcatttgaaagtcataaatatgtgcgattgcaagcaagagcagaagacatgctgtctttttaacatataacatcatttgttagctgtcctttgtaattgctcaatttttgtaaattaggaagcccaaataggcttagaattttgattaaatcctgagatgtctgagataaatgtttccagcgaacacccaccccagacagcccctcttgtagcttccagacccttctccttctgttttccactttcctgggtctgtcctccctccccagctcatcactgagtctcccttatgggctcctgcctctctgctgtcctttaaatgttcttgtccccaagttccttatttgtcactactcctcctgcacagtgccctccactcccatggctccattggggtcaggtgggatggtgaggcttgcaggggatgctgcccgaggaggtgacctttgagctgggcctggccttccagcacaggcagatgcccagtgcggtgcaggtggccgggagttgaggggaggtagggctcgagttggtagagtttcaggtgatgctgggaggactgtttggcctttgtcctgaagacagctagacctgggaggctttggagtgggcagtgatacgatcacacttgccttttagaatgattgctgttaccacagcacagaggccaggcttgtgggtggtggggctagggaccggtttgagccccgaggctggtgcgataggttgggagtgagaggtggtggcctggtgcagtgcatcagtggcctctggttgcctccacctccagcccctggcagcctggctttcctagcacttccccctccagcccgaggcccttctccagctgccaccttcatttcatttggcaccttgccctcaggcctgggcatgggctctcctccagaccccgctgtggcactgaattctcctgcattcacacctgcatctgctgcccagacagggcctggcaccaggaggccctctggatcatccagcccacggccacagctgcccggggtgccagcccctcgggcccacagcagttttgtcattttccaggggcattccgagagtcacacgggactggggacagagcccagcaaggtccatgtgggtcctacacattagtcatgacgaaccctttagaaaaatattaatacaaataggattgggtatattgttgaccagtcaacactcaccagatcaaactccatgcggtcatgaaacatgatgtgatagaatatttaatgccagggagagacattcacgatacaagtacaaaaaggcaggtcacagaaccataccacagaatgtatgtatccatctcatgtttctgtatctatacgtatgtatgtgatggtactgttttgttagttaaaaacatacacagtcatagggaaaaaaactggaagaatcatgactaaaatatcaagagatgttagttctagcttctgtagttcagtggtctcagttttctacaaggaaggtgtgctttgggttttttttaaatttttgtttatttatttatttctaattaaatatagatacgaggtctcaccatgctgcccaggctggtcttgaactcctgggctcaagcagtcttcccacctcggcctcccaaagtgctgggattacaggtgtgagccaccgtgcctggcctcgggtatgttttttgtttgtttgtgtattttttgagacggagtttggctcttgttgcccaggctggggtgcaatggcacgatctcagctcatcgcaacctccatctcccaggttcaagcaattctcctgcctcagcctcccgagtagctgggattacaggcatgtgccaccacgcccagctaattttgtttttttagtagagacagggtttttccatgttggtcaggctggtctcgaaatcccggcctcaggtgatctgcccgcctcggcctcccaaagtgctggaattacaggtgtgagccaccgcgcctggccgggtatgttttattagaataattttttacttatccaaaagcaagggtgggcacggtggttcatgcctgtaatcccagcactttgggaggctgaggcgggcagatcgcttgagcccaggagctcaagaccagcctgggcaacatggcaaaaccctgtcttcacaaaacatacaaaaaattagccaggtatggtggcgcacacctgtggtcctagctacttgggaggctgaagcggaaggatcgcctgagcccaggaggcagaggttgcagtgagccaagatcgcacactccagcctcgggaacagagcaagactctgtctcaaaaaaaataaaaaaacatggctggttgcagtggctcacgcctgtaatcccagcactttgggaggtcaaggtgggcggatcacaaggtcaggagtttgagaccagcctggccaatatggtgaaaccctgcctctactaaaaatacaaaaattagccgggcgtgatggcgggcgcatgtaatcccagttactcgggaggctgaggcaggagaatgtcttgaacccaggaagtggaggttgcagtgagccgagatcatgccactgcagtccagcctgggcgacagagtgagactccgtctcggaaaaaaaaaaaacatatctcactgtgtcggggcttcctggccactgtgttataatggtgcttaagtactctgcacacttccgtttactcctttaagagctgagtgctgcacctgtgctgctctcggtgctggagacacagcgctggccaggcagagaaggccctcattgtcaagtgggggagacaggggcagatcctgcctcgggttggatgctgtagagttcctgagaaccacgtgtgtgtgtttcccacccagtgcgccctatccactcctccacatccagccctaccatctccatccacgaggtgggccataccggagtcaccaaaactgagaggagtggcattaacagactgaggagtgaaatgaaacaggtaagaacacctcagtggcagcgagggatgagtggtggtctccctacctgggcttaccccagaaagcgacagaaacctagggcatgaggctgcagcccactgtctgtagagtgggaggtcccttctgtctgggatctgaacacacccctgtccccagatagatattccagagccggtcatgcgcacccttacccactcatccttaaccttaacgtgatgttctcatgaacgttccagaaaatacccttgtccatgtttgcctctgttcccgagaaccactcttaggagtgggccacagccattgaaaaagtagagtcatgcaaaaagtcaccgaatcatctgtgtccttcaaacgaaatagcaagagggctctggaaatagaccagaatgcccatgatacttggattctccaccagccacaggggtctcttttcttagttcacctttaattcctggtaaaaaaaaaaaaaaaaaaaatccttttgaactgaccgcacagggccacagctcaacatcggagtcttaacgtgctgggtgctgtgctaggccttgcccaggatccatgctgggaaagagtttccctctgaccatgagaaatgcactcgaattttctgctccattttaaatgctgttcatgacccactaaatggagtccatgatgcactcatgggtcaccccctgcggtttgaccaacacggccctggattaagagagagggcaatagaagaagcacgcgttcttggctcaaagctggttttgatttcctgatgtatttttgctttcagatgactaggcggtttagtgctgatgaacaggtgacacccctttgccttgttcgtcctttacttcctgttctttctggcttgaatgtggaaagtgaggctgtgactccgcagcgtgtgaatgtgtagagggcggctctatccagcaaacgggctggggcacaggcagagagcaggactcgagggcaggagagacgaccttgccccatgcctttaaaaataatctgtttctcaaactcttgggctttgtagggtactttgtgaaagagatcatccaggctctgcctcagtgggagtttctattcaaaaagagggaactaaatagaaaactaaatgggggggaaatgcggtcattggttatatcagtagaaagaatgctgctattcctgtcctcagatcgcctggggggacttaaccctggaaggaaaaacatgtaagggtgctcttcttttatatcaccctggtgacatatgttctccacccccctctgggacactggagtcgcatttctaatattttgatgtgtattaccacaagagcctagagacatcttaatgacatgtaaaggccgattccacatgttgcccagaggtaaaacatgctttatctctcctagtttatgctgtttccaagtagggaactgccttttcaaacatcttcccttgccagccactcggtggcaccgtccctctgtccccgcatcccgatggcctgaccgtgggtgaatctgagtggttccttccgcctctatttcatgctgttcttgcgtgttacggggatgaagtgatcacctctgttctttgctgggcttagagtcacctagctagtacaaactttgaccacttacgtcaaggaacatattatttgttccaaaaatgtaataggtgttatggtattttcaatctctagtctcttttgtaagaataccttgtagatagcacactgtacccttgcaaattaagggtacattctagattttagacgaggaaatacttatgtggccaaaggtatcagcccgatcatcatattcattcatttaatgaatatctactgaatgttaggtgcagcatgttagtgtcagctgtaggtatttggttcatctgtagattttcacaattcttaccataaaatgtgagcatttcatggctgtgagtttggaaaataaatagtgtcctaacttgatgatgcaccctccacatatgacaggaacatttaatgtttacattcaatggtaacagttcatgtttttaaaaagagcagttagtaagtttcacgtggagtcgaagcccagagcggtgcttgcaggtgcccctgcacctgagcttgcctatgtgcgttgctgtggcaccttctctgcgcccgcattctctgctgctgctttctgtgggtgtttcggatgctgctccatgaccctcctctctgctgtgtctcttggtgtcattgctgtcaactgagtggattctttttgttttgtagttcttttctgtgggccaggccgcgtccagcagtgcgcattcctccaagtctgcggtaacagtgcctcgggattattgtgtccgtccccgctcctcctcgcgtccttcctcatgctcccacctcatgcccaacttctgaggattcgagcagggctgaagtgttttcagcgggatgctcacaggctcctccaactggaattctgaggagggtagaaagaaggccccaaagtgcttgccctgagctttgttctccgtcttaagctctcagttctctgcctgtgctccttggcacagtgtgggtgaggagtttccttctcaccaattcccagagcttctggaaacttcggggcattagttccatgcctctttatggagccaggatggtgagcccttgcccacatgtgccaactagcactctgcacctgccatgccccagatctcgtgcagggctcggattgagctcaccgcagagcagaggctgaatcttcctcctgaaactggagggcccggatcagctgagtcattgaggagtgcagctgtaattacttttatttgtgtctaattgttgccttaagtggcagtaatgagcccaatggaataacccagccgaactgccttttcaaaataagatctgttgaaatccaactgctgcagaaaggagagctccacctcctgccctgctagcacacttcaggatttcactttaaccctttacatttgactgtgcacatttgatgtgtggcactatcgagaaacaaaagtgccagatagtcccaggcaaagagatgtgtgagagtgaaggttatcccttctcgacctggaggtctcgaagctagaagccccgcagggcaagacagaaggctgggagctttgccgcagggaggggatgcgcccccactcacagaggcccgccccgccagcggtggggagcctctcagacagtgtccccctctggagcctgaatcagtccagccaatgttgaggtgggaaggagatggcgccctcttccctcacttcagcaaagtcagccccagttcagaggcagccattgccccaaattaagataaagcccagtgccaagaatagggaaagccggaaatgggattgcaaagggtgggtggatggaccctgatctgcgaggtcctcgccactaaacgcgggcttcactgtttgtcttcccccgtgtcatgtattgccttctctgtggttcctgtcctgtggaaacgtgtctgtcacttctctgtggcactgcagcaatgaagtgggcactatggagtttgtctccctgagccatggatgcctgctccgagggcccgttgtcaccctcaaagctctcccactgcagtggcacaggcgccacgtgcgggtgacagctgcccctcatgggcacttagcgcacactaggtatgcctcaggggcttctgtgtctccacgtggtgaaggcttccgggcagctctttataggatgcctgactgtgtccccactgtgcagatgagactgaggcccagaatcagtgttcatggcagggccagacggcctcgggtgtgtccttggcaccgctggcattgagtggggattagcactccggcagtctgacccccaagcccgtgctcgccctgttcggcctcctccttatgggttctagctttgggggtgggactgcctctcggggggcagggcagagtgcaacatggaatgaagtgatcaacccaaagtatgcgagtcatctcacatgaggaaacagacaaggtggactggaggaaccgtgttcctctctggcgagtggtgttctggcatttgtgcctaggtcgcagggccgcccttcgagatggcgcactttccctggggcacctgctgcgtggcttctgaggccccaagctgtctgtcttgcagaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaaggtaagccgagacgcgagctcctggggaagtgaaccgtccccttactgtcctggcaaggcatggtggcacctccaggcgagcaaacacacagccctgaggatggcttctctgcctcagcgctgttggcacctggggccgaggcattctctgctagggggcctgtgcgtggtaggatgtctacagcatccctggcctctacccgccagatgccagcagccatctcttctccccaccccacccccgtgtgacaactaaaagtgtctccaggcattatcaaacatcccgtgggaggcagatcaacccagttgagaaccacagcaagtaagacaaggtggcagtctaggttgtggttgtgtgggaccaacttggacgtattttaggaacatagaagaacagggaaaggctgggaggcttcagatgaaaaccctgtaaaaccacccagagcagcacctacaggcctggaacctggaatgacagttcaggaggggcctggagtaggccagccccccagcctcccgcacatccaggcaggagtagtgtccctgctgttcagcgatgtgactgagccccaccctcccagggtacctgccgtgttcagtcccaaggtgtacagaggtggagagcttccagtttagccccaggtcctgtgtgccctgaaggcacaatctccctcacaccctggggccccactcccctcagccagccggctgttgcgcttcccatctgcctggggccgttcacgtctccccagctgttgtccctgggaactgtggtgcctgtacctgagcacaggagcacctccctgagcgcctgttgtcaaggaggggggcagcattctctgtacccccccagtgtctcccttctgcatcagcccgagagagtttatgcagctccctgggctgcaccaggccctccctgtcttttcccttgaatggaaggacagtgtgcctcgcttaaaagctgtgcaaaccaagacatttttttccccccagaactattttttagttcatttcacagtgggagagaagagaaaaaataatcccagtgacagcatacaacagcccccttcccaaagccatggcaccacttgctcaaggttctttctgtaacaggggcccctgtgcttcatgggccccaaggtattcctcacggccaccgcagagggatgtgaggaggtcggagcaggccctgcccgagcagctggactcctgggacccaggcaggatcctgcaggggctcatggtgcttgctccacttcccgcctctcttaagggggtgggagtgtccactgctgttctgccctcagcccactggggacgctccaggccggggtgctgggatttagaaggtggccagttagactagaacaagctgttcctagaaaatttccccactcttcctggggcatcacatgcttccgctcggactcactggcgcaataccaagatatttctattatgaaaaagcattttgtgttgagctggcactcgatatttatatacatgggtgtgcatgtgcatgtctgtgcatgtgctggaggcttttgtgattggtgcttattatagaaatctcaaaaatagatgcctgcaaaggcacagaagcatcccttccccagcaggagccatgaaaatccccctttattatggcaccaaaggggcctcgcagccgcccgggcccagttgccaagtacaatgcggagcctcccgggaggactcggcagccccctagggcattgttcgggggagatctgaaagatgcctgctgggttccctagaattgttccatcgaaaacacagcctgtgggcagtgagaacaagctctctaaaaataactctgacagtctggcgtgtcccagccctcatatgggtttccagggcagagggtgctgtgtgtgcatgcacgcctgtgtgtgcatgcatgtgcttatcccattctggaatctgactgaaatgcgctctattctgcctccagtgccacggtctctccatcgatggttatgtcctcccatcctcgacgacccgagaggtacgatgagaaaaacgcagaggcgggcccctctgtgggttcacaataagggcttcattgcatggactctgacctcttgtgctccttttgggctcattctaattgacaggccatttgtagctctgagctgtctagccccttcaccctcatatttggcaaaaatgtctttccagcatttattggcatcagcctttttcttcacctgagactcagcatttctgggctagcaagctctttgcatttgccagacaccccttagaaccctggtgaaagaaaggagccaatctccatgccaccctggcctgccccatgggcagccttctcggcccttttctccaactaaaaacagtaatcgtccctaggtgatttgtcattctttttaacatggatttttttttagttttaccccacccaaagcaccatgcttcatgctggaaggaataatgaagaggaaagagaaaccagaaatggtccctgctccctggaagctgtagtcgatggggggaagggtagataaatcaggcgaggacaggctggctcctggaggcatactccagcctcctgctctgagggccactgccagcaggatccagggagtggccagaaaaggggcagcagtggcgctgagccccgagcccaggcactgctacggtcacccttggttactcggtgattgattgatagggctgcatctgtcctctcactggtggttgcctgcctgtccctttggtagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgggggtgccagggagctgggttggctggcatttatctctgttgaggctggagattctgtgtccaataggaaagaatatactcgaaccaagaaaatgtcatcacagatgatggggaaaaaatgtcaaccacttgcttagaaaatggtacagtggccacttgggaaatctcaagacctttggggatggataggcctgtctcaatgcaggttttcgtccaaacaccaccacttgcaacacatgtgaccatgggtgaaccccttaccctgtacacaaagtcaagttcaacagagtagtcctcattatagtcaggagctacaaactagggtgcgtgataacagagtgcagtgcccagagaggtagggcattccccctggcagcgctggcttcgtgccctcatgccctcagaattggagcctctcagaaggccaaggctctactagagcaaccctcacccctgcccatgttgacccgctgccaccaccacgcagaagcgtgacggggagtgggggctccgcttattgtcccctctgccctttcctactgcaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgc

SEQ ID NO: 4362 - DNA, 13118 bp, human
ctcctcctcccttcctccttttccttcctctctcttcctccttcccctgtccccctcaccttccctccctcacctctccttctgtgcttgcccccttccctccctccctccctcctccctgtctcctgggaggctcctttaccccgcctccccctccttctgctctccctcctgctgtgggggttgacagaacactgcatgtctgtccttcctccggcaatttcatcttcttgagcacagggactgcatcgcagttacctctcagcccttctccagggcgtcctaacatgacacactcccagggacagtgccccggcacgcacagagattgtcacacgtgtttgtccacagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccaggtatttgcccgagggagggcaccgactcttcccgctccctctgcccaggtcccagtccccagacaggtccaatcaggacctcagttcctgccgccctggaacatctgcatagttacggtgatcactgtaaatgtttccctaacgtccttcccttccccaacaaaacaaaagaaaatacaaagaaaaaaagctctgccgaaacatgaatttgcagataccgcagtgattccaggcactggtggggcggtgctgccccctggtgaaaaccagccagattgtagcagaaagcccgaagcaccttctctggcctctcatgatccggttttgagtcctggagttaatccccagctgtaggacacgctagagctgccctcagaagctgggagaacagccaccttggggagggtggttatgggtgaaaataactgattttgaactagggcacaggactggcaaaccgattcccctccattatttcagtttatttattattgttttttaatcttttttttttttttttttagacagtctcactctgtcgcccaggctggagtgcagcggtgtgatcttggctcactgcaacctccgcctcctaggttcaagtgattctcccgcctcagcctttccagtagctgggattacacagcgcctgccaccacacccagctaatttctgtatttttagtagagatggggtttcgccttgttggccaggctggtcttgaactcctgacctcaggtgatctgcctgcctaggcttcccaaagtgctgggattacaggtgtgagccaccgtgcccggcccccctcccttatttcagatggaaaagggccttttaggaagaggccgctgctccgctctgaactatgtctatggccttgatgggggctcttacaaggggttaaacaggaagccattcacagaggggcttagctgtacacccaccagggagaaggggccaggaccctgacaggaaggttatggagggaacaaacagagaccccttctcacctgggagttccacaagtttcttagcaaatggaccatcttgtttcccccagtgtgttctgaactctcgctctctcaatctgactcaatgaaaatgatttgtgtgtgttttcagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaagtgctccatctggccctagggaacacaccagatcttggaattcagttaccacctcctcccatagcccccatctcttcttaactgtatacacctgaatcccaagcttcagcagctcctcctaaacaatgaagtccaggaaatggcatctgggtgaactggctgattgcatgcggcccccaagaggatgagtgtaggttgccgtgattctccgtgcaatgcactggaaatctggatttttgtgattttagtttattttattattttttttttttttaggtaaataaaattttgaggaaccacttaattaggccccactggatgttcgcgatggacaacatcatccgccgagcggtgcaggccgcggtcaccattctcatcccaggtgagcgccccctttgtggtcaaggtcagctttaggccgtgaaaagataagaaatatcctcttcattcaacagttgttgcttttctcttttccatcttggttatctacttccttggaattaaatgcatgttgtcatagacttcttccggggctgattctgtagttctgagagcatctcgtggtgctgtatttacgtgtccctgaagcatgatgaaggtgactacacataaactataactcacaatctcaaaagggagcatggggccggacgcggtggctcatgcctgtaatcccagcactttgggaggacgaggtgggcagatcagctgaggtcaggagttcaagaccaggctggccaacatagtgaaaccccgtctctactaaaaatacaaaaaattagccaggcttggtggcacgtgcctgtaatcccagctactcgggaggctgaggcaggaaaatcgcttgaacccgggtggtggaggttgcagtgagccgagatcacgccactgcactccagcctgggcaacagagtgagattccgtctcaataaaaataaacaaatacataaataatattaaattaaaagggagcatggggccagaggggaaggatcctccagtcctctggtatccccttcatcgtgcactcaggaatgtttcttgggtaactgacaatacagtggctcagattcctctctctgaatcatcatgtagtagttacagaagtttttggtttttgtcaatttcctttttgaaatgttaccaaagttgattctccttctctggtgacttcttcctgctaagggaggctttacagcccattctgtcgccatcatggtttccccctttccttcagctccttgctgtttggctccagcccaccctcccgaatgcactgtgtagcccaggctcagctgcaggagaggcttgggaaaccccagtgcttaattcctctcccactccaagcagacaccttctgtagtaaaacggcacaggcttgggtggcagcctggctctacttatttctttcttttctttttttttttttctgagacagagtcttgctctgtcacccaggctggagtgcaatgatgcgatctcgcctcactgcaacctccatctcccaggttcaagcaattctcctgcctcagcctccggagtagctggggctacaggtgcgcgccaccacacccagctaattttttttagtagagacggggtttcaccatgttggccaggatggtcttgatctcttgaccttgtgatctgcccgcctcagcctcccaaagtgatgggattacaggcgtgagccactgcgcctggacctggctaatttttgtatatattttttagtagagatggggtttcaccatgttggccgggctggtttcaaactcctgacctcaagtgatctgcctgcctcagcctcccaaagtgcttggattacaggtgtaagccattgctcctggcctggttgtaccttttgaacgctggccttggttcacttcatatccttaagcctcaatttcttcctgtggaaactggcgtgatcaactttacgctgcagagaaccaaatggaacagtctcttctccatttgtaaagtcagcagtcccctaatggagcatggcacgggctgggccagcttctgaacagcccggtttgctgacctgggtgtctgcgaccccaggccccactggcctggtttgctcaccattgtcatgtcttgtgtgatttgcagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacaggtgaggagcttctgggccctcctctgggagcaggcgctgggacagtggcctgagccaccaagatgctgattaattggctttattgttgaccatctcacccaggtcttaggaaaaagcagcttcatcatccacgaactaggcaagggcgcatattctcagcctcaattgagggactagaggaatgccttcctttaaaaaaaaaaaaaaaaaaactcagaatcagagaggtatatatagtaccttgccccagaccacacagaaattactcatactaaaggcagcagcatctgtgaattctttctctcttttcaccaagacggggcccctggcatggtgtgtgggtctcgcaggctcagcagcctgcccctgcagaagtagcagggtttgggggttggttagcacttcatcagtggatgtacatcccataatcccgaccccgaggaagtttgtcctgttgtcatttcttccatgtgatttgtcatgatccctagacgggcattagtggactagcttcccaaccagggaaccctggcatcaccatcatattcctccaatgcactggtctgttttgttcacttcctggcacatagtaggtgcttaatatttgtgaagtggatgggcgtggtggctcacgcctgtaatcccaacactttgagaggccgaggtgagtggatcacttaaggtcaagagtttgagacagcctggccaacatggtgaaaccccatctcttctaaaactacaaaattagccaggtatggtggcgcacgcctgtaatcttagctgcttgggaagctgaggcaggagaatcgattgaatccgggaggtgggggttgcagtgagctgagatcgtgccattgcactctagcctgggcaatgagagaaactccatctgaaaaaaagaaaaaaaggggaagaaatatttgtgaaatgaataaaattattcctgtttgctctgggaagtcacattatcagctgcgtgatttggtttttaaaagtaatccatagttgaccgggcacagtggctcacacctgtaatcccagcactttgggaggccaagatgggtggatcataaggttaggggttcgagaccagcctggccaatatggtgaaaccccgtctctactaaaaatacaaaaattagctgggcgtggtggaacttgcctgtaatcccagctactcaggaggctgaggcagaagaattgcttgaacccgggaggcggaggttgcagtgagccgagatcgtgccactgcactccagcctgggcgacagcatgagactctgtctcaaaaaaaaaaaaaaaaaaaaaaaaaaaaaaaaaaaaaaaaaaatccatagttatagcaaatgagttggtactcattccaaatgacactttgttgctgtgggatcattgctgaggaatgctaatgactatttaaccgggagacaaggggccagttacgtattttggatgaaaggttgtgtatgctgtcagggatctctcaagttcaatcttagatcatctaatcatttctttttttaaaagacccagagctttagttaaatggtagtggtggcaacattttgaaagtttttttttttttttaagttcaagagtacaagtgcaggttttttacacaggtaaacttgtgtcatgggggtttattgtacagattgtttcatcacccaggcattaagcctagtatccattagttgcttttcctgatcctcctcccagcctccaccctctggtaggccccagtgtgtgttgttcccctctatgtgtccatatgttctcatcatttagctcccacggcacgtggtatttggttttttgttcctgcatttgtttgctaaggataatggcctccggctccattcatgtccctgcaaaggacatgatctcgttctttttttatggctgcataatattccatggtgtatatgtaccacattttctttagtctatcatcaatggacatttaggatgattccatgtctttgctattgtgaatagtgctgcaatgaacatatatgtgcatgtatctttataatagaaccatttatattcctctgggcatatacccagtaatgaggttgctgggtcacccaataagatttataatcaccaaattcataaaatgattatatatgggtttgaaggttatttctctccactgtcgatagtcattgtgttattttccagtctcagtggaatgaggaattggttaggcagcagccagtctgtgaatggcattgacgtaaactgtacattcctgcataaggtgcttgtccttgtgtgtattagtccattttcacgctgctgatacataccagaaactgggcaatttataagagtaagaggtttaatggacttacagttccacgaggctggggaggcctcacaatcatggcagaaggtaaaaggcacgtcttacatggcagcagacaagaaagaatgaaagaaccaggcggaaggggttttcccttataaagccatcagatctcatgagacttattcagtaccatgagaacagtatgggggaaaccacccccatgattcaattatctcccactgggtccctcccacaacacaagggaattatgggagctacagttcaagatgagatttgggtggggacacagccaaaccatatcactgtagtatgaagtgccttggctatgtggcagttgggcagagccaaaggaagatgacacctcttagacaggatgatgtgtctgtcctgatgaagtcctgagagtccttcccactggatacaggcacaagcttgagttgtctccttcactaacgtaaaaggaggactactagagagaccaggatgaaggcaggcagttgggcagggctgggagaggacttctaatttgctgagtgccaatatttcctctgctgttgtgctggggcagaagtgttctcctctccccaccccactttgccaccaaataatccaggagttcctgtgttctcatctctctactgttgcagtgacttctcatggcaacttcaataattaccttcagtctttttttttttttttttttttttttgagatggaggctcgctctatcatccaggctggagtgcagtggcacattcttggctcactgcaaccttcacctcccgggttcaagcgattctcctgcctcagcctcccgagtacctgggaccacaggtgcacaccaccacacccagctaatttttgtatttttagtagagatggggtttcaccatattggccaggccggtctcaaactcctgacctcaggtgatccacctgccttggcctcccaaagttctgggatgacaggtgtgagccaccacccccagcagccttcagtaatttcaataaagcttagttctgtattcccaagttcaccagcatggatcatataaatgaattaaaggaacacacagttaagaaacaaatcccatgtactaggtatgtaagcaaacaataaaagtgtgggggccaaggcccttggcccctggaggtttgctgaaaatcacctgcatgaggctgattaatgagagaaaaggcatgcaaatgtatttaacatgtatttaacttcagcatgaagacccaaagatccaggggaaattgtccatttttatgcttaggcttaacaaagtatggagagctgtggagaaacagggataaaaagggcctgatcgaatgctgatagactgagtggggaaacccagcaaggcctgtctgtctagatccttcttggcctctctgagtagcattcctttctcctgggtgtggggcaggaccctctggaatcgggggtcttatgaactacagtcaaacaaagtaggtcgaagaactttttttttttttttttgagatggagtttgactctgttgcccaggctagagtgcagtggtgcaatctctgctcactgcaacctctgcctcctgggttcgaactattcttctgcctcagtctcccctcccgagtagctgggattacaggcgcacgccaccacaactggctgatttttgtatttttagtagagacggggtttcaccatattggccaggctggtcttgaactcctgacctcaggtgatcctcccgccttgacctcccaaagtgctgggattataggcttgagccactgcgcccagcccaaagaatttttttttttttttttttttgagacagagtttcgctcttgttgcccaggctggagtacaatggtgccatcttggctcaccgcaacctctgcctcccaggttaaagcgattctcctgcctcagcctcccaagtaactcggattacaggcatgtgccaccacgcctggctaattttgtatttttagtagagaggcttctccatgttaggctggtctcaaacttctgacctcaggtgatctgcctacctcagcctcccaaagtgctgggattacaggcttgagctgccgcacccggccaagaatttctttataaccaatttttacacagaaaggcggagggaaagttagagtcgtatttttaggttttgtggctggctttggggaggagttctggtttctgtgccccgctttggggaagagggattctatggtgcctccaggagaatggactgagagagggaggcaggagaaggtcagaggaaaactttttcttctgaggctgctgctgaggccatttgggggcactgttttctgagccccaacaaaagctagacgtggttccaatctgtcagccctttcccccaaggcatgctatgcctgagctggcatgtgggggaagtttgaggcacagttgtgccaagtcatatctgatcccagagagcccatgagcaagactgggtttcaggaggcggtcccttgggaagagcccagcctgtggactctgggcgttacttaactcctctgcctcagttacctcagcttcaaaacaggggtttagaacaaccagtgcttcctagaagtgccgcagggcttcagtgactgaattcatgcagtgtttggcacagtcctggattctgggtaggaagtgcttggtggatgttggcaggagccatcctccccaccggcagagcagcatgtctcactcactgtccctgctctgccccattacaagcaggggcttccagctgggtgcggtggctcacacctgtaatcccagcactttgggaggccgaggcaggtggatcacttgaggtcaggagttcgagaccagcctggccaatatggtgtaaccctgtctctactaaaaatacaaaaattacccatgcatggtggcgcatgcctgtagtcccagatactcgggaggctgaggcaggagaattgcctgaacccaggaggcggaggttgcagtgagccgagattgtgccactgcactccagcctgggccacagagtgagactctgtctccaaaaaaaaaaaaacaaaaacaaaataagaagcaggggcttctgtccccttcgtttagtccctgtgtgaggaggaaagaaacttaccattctattctagtttcagctgccttatctgacttagggagccaggtttaaataatcacatcgtccttctggctgagttctgattaacatcggcatcttttggttcacgatacgtttttgagacaaaactgcctgagtgcgttcaggctactgtaacaaaataaccagagaccaggcagcttataaacaacagaaatgtgtttctcacagttctggagactcgaagtccaagatcgaggtgccagcagattccgtggccagtgagggcctgcttccccattcacagatggccatcttctcgcggtgtgtcctcacatggtggaagggatgagggagcctctggggtctcctttcacaaggacactcctctcacctcacctctcaaagctccgtctcctaacaccatcaccttgtgggttaggatttcaacatatgaacttgggccgggtgaggggcacacattgagtccattgcaaaaatatatccaagctgtgagcactggcctttgttgtcaaggggaggaaaacacaaggaaggttcccctctgcagactgaagtctgagtcacagaacctgaagaaacacatgtgcttccctctctaggctgactcttagacttgtcccattttccattttttttccatctctaatgtatgcacaacagatgcttgagttaaattgaatggtgttgaatgctctctggataatggctttttttttttttttttaaaccagacttttggaacacctagttgaaaaagagagagagtaccagaatcttctgcggcaaactctagaacagaaaactcaagaattgtatcaccttcagttaaaattaaaatcgaattgtaagtcattttccaatgagacagactttaacatctagctaatattctagttagctttgaagaaacatttgaggttatcttctgttaatccaggactccagtagattctagactacttctcaatcataaaaagggactactgatagattcaacaacatggctgcattgtaaatgcagtatgctaagtgaaagagctagattcacagccagcaccgtagctcgtgcctgtaatcccagcactctgggaggctgaggctagcagatcaattgaacccaggagttcaggaccagcctggtcaacatggcaaaaccccatccgtacaaaaaatagaaaaaaaccagctgggcttggtggatgcatgcctgtagtcctagctacttaggaggctgacatgggaggatcacctgagcccaggaggttgaggctgcagtgagccgaggtcatgccactgcactctggcctgagtgacagtgaaaccctgtctcaaaaaaaaaaaaaaaaaaaaagattcaaaaggccacataccatgattccttttcctccagaaaaggcaaaactacagggacagaatcagaatggggaggtgacgggactgattgtaaagggcacatgaggacttttgggagtgacagtcatttctgtatctgtgctgccaccttcatagcacattggacacctaaaaagggtagtttactgcataagtaaataaatatgcctccatcaacctgacattcgttttgggccacttagaaacgagctccagagctacctcttggaatgtggactagataagctctgacctcaacactaaaacctatttccttgtaggatttccagtgcagttagggatgtgattcctaaggaaaggcatttgaaagatgtggggataagcatttaaagtggtagacctaacatgtcaaattccaaactaactgaaggtatcctagatgaggaggctttctagaaagtgaatctcagaattatgaattgtgtaatacgtattagcgtggttcagtgatacagggttaattcatctctttttcacatcacatttacattctggaatcatttattaatccaactggttacttttgaagagttttatggttagactaatatataacaaattgccaatcgttacaggtattacagagaacccagcaggcccctacgggcagagaacagataaagagcttatagactggttgcggctgcaaggagctgatgcaaagacaattgaaaaggtaaatttacaacaaagaaattcttatgctgttgttacacagctgctcagctcttaaggatctgatctttgtttcagattgttgaagagggttatacactttcggatattcttaatgagatcactaaggaagatctaagataccttcgactacggtaagagcctcaaaacagtttgtataagagaatacaactttttatgtgtgaatatgcttcaagagcagaaaacaaagggctgggcctccccccaaactctggagttctattaggttcaagctgggaaaaagccaaggtggggcagaaactgaaagccaggcagaagtcagaaataggaatgtgacagagaagagctggccaatctcctgccattaatgcctggctgggagtgggtggaggcacatggcaagcgtgcctgcacgctggacccacccccttctttaaactgcagcctgccttcttgttcccgagtcatttgaaatagccagctctctgcaggtacgtacctctaaggccatgtcctactactgctgggacacgagcgtcacctccatatgtgaggagaatgtttttattttcattaggtttttaaattagggactgcagttttaagctctgttggcttgaagcactgactctgaagacagctgtgtttgtttcccaggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgtatacacgaattccgctgtgtttacatatttaaaaatgccattgttcaattaatagtttaagaacttgttttaaatactgtcctgagtttcttttgaaacctgttatttataaacatagaactgtgtgtattgtgaaaacagtgagccttggttttgacctcccggaatattaggaaattcacttgtagtcccagctatgcaggaggctgaggtgggaggattgcttgagcccaggaggtgtggaggctgcagtgagccatgatcacaccactgcactccagcctgggcaacagagcccgaccctgtctcaaaaaaagtacacccttcagcacttgctggaatggtgaaacaaacaaggggtatttaacaaacatggaagctgggacactgcctcagaactggtatggtacttcaatttgagaaacacaaaactgatacgaatgtgccttgtagttaatgtttgatatgaacagaaaatagcttcatatttatactgaatgtgtaagtagagaaaactaagttatgtggcctttgaaatgattacaaaattggaatgattacaaaagtcttattttaaaatggaactgtcctcttgcctgataataaatattgtatcttg

SEQ ID NO: 4363 - DNA, 155205 bp, human; identical to SEQ ID NO: 3204

SEQ ID NO: 4364 - DNA, 100069 bp, human; identical to SEQ ID NO: 3205

SEQ ID NO: 4365 - DNA, 125845 bp, human; identical to SEQ ID NO: 3206

SEQ ID NO: 4366 - DNA, 122220 bp, human; identical to SEQ ID NO: 3207

SEQ ID NO: 4367 - DNA, 155205 bp, human; identical to SEQ ID NO: 3204

SEQ ID NO: 4368 - DNA, 100069 bp, human; identical to SEQ ID NO: 3205

SEQ ID NO: 4369 - DNA, 125845 bp, human; identical to SEQ ID NO: 3206

SEQ ID NO: 4370 - DNA, 122220 bp, human; identical to SEQ ID NO: 3207

SEQ ID NO: 4371 - DNA, 155205 bp, human; identical to SEQ ID NO: 3204

SEQ ID NO: 4372 - DNA, 100069 bp, human; identical to SEQ ID NO: 3205

SEQ ID NO: 4373 - DNA, 125845 bp, human; identical to SEQ ID NO: 3206

SEQ ID NO: 4374 - DNA, 122220 bp, human; identical to SEQ ID NO: 3207

SEQ ID NO: 4375 - DNA, 155205 bp, human; identical to SEQ ID NO: 3204

SEQ ID NO: 4376 - DNA, 125845 bp, human; identical to SEQ ID NO: 3206

SEQ ID NO: 4377 - DNA, 171687 bp, human; identical to SEQ ID NO: 3216

SEQ ID NO: 4378 - DNA, 264058 bp, human; identical to SEQ ID NO: 3217

SEQ ID NO: 4379 - DNA, 353626 bp, human; identical to SEQ ID NO: 3218

SEQ ID NO: 4380 - DNA, 353636 bp, human; identical to SEQ ID NO: 3219

SEQ ID NO: 4381 - DNA, 209997 bp, human; identical to SEQ ID NO: 3220

SEQ ID NO: 4382 - DNA, 134172 bp, human; identical to SEQ ID NO: 3221

SEQ ID NO: 4383 - DNA, 136991 bp, human; identical to SEQ ID NO: 3222

SEQ ID NO: 4384 - DNA, 171687 bp, human; identical to SEQ ID NO: 3216

SEQ ID NO: 4385 - DNA, 264058 bp, human; identical to SEQ ID NO: 3217

SEQ ID NO: 4386 - DNA, 353626 bp, human; identical to SEQ ID NO: 3218

SEQ ID NO: 4387 - DNA, 72647 bp, human; identical to SEQ ID NO: 3240

SEQ ID NO: 4388 - DNA, 299181 bp, human; identical to SEQ ID NO: 3241

SEQ ID NO: 4389 - DNA, 107017 bp, human; identical to SEQ ID NO: 3242

SEQ ID NO: 4390 - DNA, 353636 bp, human; identical to SEQ ID NO: 3219

SEQ ID NO: 4391 - DNA, 209997 bp, human; identical to SEQ ID NO: 3220

SEQ ID NO: 4392 - DNA, 134172 bp, human; identical to SEQ ID NO: 3221

SEQ ID NO: 4393 - DNA, 136991 bp, human; identical to SEQ ID NO: 3222

SEQ ID NO: 4394 - DNA, 353626 bp, human; identical to SEQ ID NO: 3218

SEQ ID NO: 4395 - DNA, 299181 bp, human; identical to SEQ ID NO: 3241

SEQ ID NO: 4396 - DNA, 353636 bp, human; identical to SEQ ID NO: 3219

SEQ ID NO: 4397 - DNA, 353626 bp, human; identical to SEQ ID NO: 3218

SEQ ID NO: 4398 - DNA, 299181 bp, human; identical to SEQ ID NO: 3241

SEQ ID NO: 4399 - DNA, 353636 bp, human; identical to SEQ ID NO: 3219

SEQ ID NO: 4400 - DNA, 64595 bp, human; identical to SEQ ID NO: 3288

SEQ ID NO: 4401 - DNA, 110281 bp, human; identical to SEQ ID NO: 3281

SEQ ID NO: 4402 - DNA, 108582 bp, human; identical to SEQ ID NO: 3282

SEQ ID NO: 4403 - DNA, 110281 bp, human; identical to SEQ ID NO: 3281

SEQ ID NO: 4404 - DNA, 110185 bp, human; identical to SEQ ID NO: 3285

SEQ ID NO: 4405 - DNA, 109923 bp, human; identical to SEQ ID NO: 3286

SEQ ID NO: 4406 - DNA, 64595 bp, human; identical to SEQ ID NO: 3288

SEQ ID NO: 4407 - DNA, 110281 bp, human; identical to SEQ ID NO: 3281

SEQ ID NO: 4408 - DNA, 108582 bp, human; identical to SEQ ID NO: 3282

SEQ ID NO: 4409 - DNA, 110281 bp, human; identical to SEQ ID NO: 3281

SEQ ID NO: 4410 - DNA, 110185 bp, human; identical to SEQ ID NO: 3285

SEQ ID NO: 4411 - DNA, 109923 bp, human; identical to SEQ ID NO: 3286

SEQ ID NO: 4412 - DNA, 17326 bp, human
cgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaatgccgcccggacccccggaccacggctctgctcggccgggtctcccaggtcctgcccgtagattgcaggtcacccaggccgcagtgaccctttttccttcccgccctgcctgcccgcggctgggcgccccacacgcgactctgagctcgggagaggagctgggaagttaactcctgttgcccagtttggtcacattggggtggagccggcgccatttttgtagggcctcctgcgggagaatgtgggcttttgctcctgattcgcgccagactgaccgctgctcggtggggacggtggcgggaaccttccccggggcggcctaggtttagtagataggcccctttggccttcccgggcatgaggggttataatccctggaagccgttctgaactttcagagtgctgtctgcattcgtgagcaccaggtactcctgcatgggtttctttatggacagttcagtattgttgaggctactcgctgtcccttgtgaacagtgggtgaaaccttgatacatttctaaggctcacctctagagatttactctctccatccctttacaggatatagcttatgtttgtttgctgaagacttattccatattgagccaagttttctacttttgcttcagatgatgcatatgttgtgagaataaagacctaatttaagtgtcctccattctgaggctaagcgttcacaaatgatcagacttgaggataactttatttgggatttccaaaacggaaggcctaatcttaaaaaaaaaaaaacaaaaacaaaaaacagaacactcctaaagaaattacttttatagatttacagtgttcctgtcatttttaatagccgtataacttgaagaaaattgtgcaagtaaatatagggaaaatactgtattttcctacaggagaggagcatacttcatagtccgtaagtagtctcctttgattattcattctagaggaaaccctcccctgacacaggcctacttctgctctcttttctacttgacagctggctccagggattctaccacatttcctctttgtagctgtcacttattactttatcccttagggtacttggtcgaggtgttctgtgcacaagttggtgcagtcactgctcattattttggaaaagatggagttataaacaaaaaattttaaagtcttacagttttcttctgtataatcctttattctctctgaggtggtaaggggatcacttccatcttattctcacctttatttctagtaataagatttccaattcttccaccaggctgtaagctctacaaggcaggaatagtatctgtcttaatctcattggattgccagcacttgacaattagtagatgcttaataaatatttgttggtttaagtcacctacctcctgtcgactccacccttagtgaataataggttctgctttggttccaaggggataggacttctacactaaatcacatctagttccctagcctcatgtcttaagaaagagcctctctgggaatttctccaaaacaactctggtttaaagaatgttgatgtcactttaattgttgtacactcagacctagtctcattcattcaacagagaatttaaagaacatcccattacatggcaataaaatacaaaggggagtgatccgggtatggttaattctggtaaattgacaagtaattagtcttttcttaaataacatttgaggcatacaaaaaatacagctaacatgatatacctgggaacccattactctgaatttaagaattacagcgcagattgaggtaaagccctaatcaccttttactctctttttggaggtaatcaccaggctgagtttggtgtttatcattcctgtactgtctgaaaccaatcagttcttagttatcttacttagaggaatggtacttttcatgacctaatttaagtgtcctccatttttttttgctgcttccaagctcttcccatgagtctcttagggtcattaccacttacagcctttttcctgccttttggaaatggctgccaatgtggtttcctttctggaatgggagcaaaatgctgtggagaggtaagcttatgtgggggctaggggcaaaaaaaacattgtgactttggtcaccccagcttactgactgtaatcagtgaactgatttactcactgaagctaagcgacttacttaacttctctgagcttcagggaactcatgggtaaactgggaataaatgaatgttatgacctcatggggtgattgtgacaagtaaatgggcagaattattgcatagtggttaagagcatggtcactggggtcatataatagaaacagggatgttgagtagggaccagcattataaaagaaagtaaattgggtaccgaacagatcttctttattttttaagagacagtgtctcgctatgttgcccaggctagcctggaacctcctgggcttgctcaagtgatcctcccacctgagcctcctgagtagctgagaccctaggcgcacaccactgcacccagtgagatttcaatatttatggtactctgctaccaaaagtttgaaaaccacagttctctgtccagacactgtcttcacttaattttgaaagtatcgggttccttgcatagggcctggctttagaagacacccaagatttccgcttagaagaatatgtatagaattgcatttttatttcaaaaggatgggtgctaaagtgaaatgtttttctatattttttaacataatatctgctatttatgtgtattttatgtcagaaaaatccccaaaggaaattccaagaagggtagggaggtgataatgtgttaatgttgggattggagattgtaaatttaatatgattgtgtagctaaaatagatgaattttttaatttaagtgatcttttaaaaaatggttttataagccttaatttcattttatttcatactgttttacagataattaatgtcatttacctccttttcttttttttaaaccatcaggtaaaggaggtaaaaacagacgcaggggtaagaatgagaatgaatctgaaaaaagagaactggtattcaaagaggatggtcagggtaagtgttttcataaattacgctttttaaaataacatcctttcttttttagctggggactttatttttttgagacagcgtcttgcccatcgcccagggtgaagtgtggtggcacgattacagcccactgcagccatgacctcctgggctgaagcagtccttccacttcagcctcccgagtatttgggactacaggcacacaccaccacgtctggctaattttaaaaatttttttaggctgggcgcagtggctcacgtctgtaatcccagcactttgggaggccaaggcgggcggatcacgaggtcaggagttcgagaccagcctgaccaacatgatgaaaccccgtctctactaaaattacaaaaattagctgggtgtggtggcacgtgcctgtaatcccagctactcaggaggctgaggcaggagaattgtttgaacctgggaggcggaggttgcagtgagccgagatcacaccactgcactccagcctgggtgacagagggagactctgtctcaaaaaaaaaaaaaaaaaaaaaaaaaaaactgtatagagatgaggtcttcatatgttgccctggctattctcgaactcctgggctcaagtgattctcccaccatgacctcccaaagtactgggaactaagaatgtgtcgtatagttcagagggaattgagctatggttgacagttctgtgatttagttggcagttctatgattagcatttctggtagtgaatggtacatataatatgttgagtagaccatggacatttgaaggatgagcctgaggcccttatagacctctccattctccagtgccattagcatataacttcgtaaactacaataaaatgaaactgaacagttaactgattttattagactgaagaatattgtaagtgccagaccaagatacatagcactagtcaaataaatcctaactggatcgtttgccctttcctgttacttttatttcgagtcatttcaaacctacagaaagttgcagtattagtgcaacaaactcccttaaatccttcatctgtacacacacatataaagaaatatatatgtgggattttttaattttttttttgagatggagtctcgctctgtcgcccaggctggagtgcagtggcgcgatctcggctcactacaagctccacctcccgggttcacgccattctcctgcctcagcctcccaagtagctgggactacaggcacccgccaccatgcctgggtattttttttgtatttttagtagagacggggtttcactgtgttagccaggatgggtctcgatctcctaacctcgtgatccacccgtctcggcctccgaaagtgctgggattacaggcgtgagccaccgcacctagccccatatgtaggatttcttcaggaccatttgaaatttagagacatcatgttacttttcccttacttgatcatgtatcttctaagtgcaagtatattttcttatataactagaagagaattatcacactcaggtaatttgacattgatataatatctagtatatactccatatttcctcaggtattccaattatttccagtactttagcttttaatagaactttgggtggatttattacgccatacatataaaccagtaaacatgagatacgttttctggctaaaagtcctttggtttcttagccttggtcatccttgcctctaaaatagcagctgacttgacttgggcatacactgttttattattactttttccctcacttcagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgtgtgcacgcacacgtgtttataaaggtagcagttgtaggaatgaatgagattgggggtgagggggtgcatatgtatgtctatgaaagcctaatcatttctgggcaatgatgtaaaggttttacgactgacctttgtaactatgaagttttctacacttgacctgagctcagaaaaaagaaagaaagaaagaaatgtcatcatagagtcttagttctagctctgccgttaactaacttgatgtttatcactcccttatgtttgtttatagttttactatatgtatttattcccaactggtgcaactttattctcttgacagttttatgtggactttaagttgctgttatcaaaagttgaacaatattccatacccttttcctttctccccgctagagtatgctcaggtaatcaaaatgttgggaaatggacggctagaagcaatgtgtttcgatggtgtaaagaggttatgtcacatcagaggaaaattgagaaaaaaggtaggtgtgatttgttttactttaatataaaattggttaagggggaaaatccctctacagtttttaactgtccatggacttcatttttggaaattcccaaaagacttaccttggtaaacagtgatttacctataagtaaaatagcaaggtctgtaatggtaattttatacaggttctaatgttaaagaagcatttgtatcacttgtattgtattcctgcccaaaaagtccaaattgagagacattctgcaaaaacaaacggcccagttttttttttccttgtcttttttttgatacagggtctcactcttatcacccagcctgtagagtagtggcatgatctgggctcactgtaacctcaccctcattggttcaagtgatcctcccacttcagcctcccgtgtagcaggggctacaggcctgtgccaccatgcctggctaatttctgtattttttgtagagatggggtttcttcatgttgcttaggctggtttcgaatcctcagctcaagcaatcagcccaccttggcctcccaaaatgctgggattataggcatgagccactgtacccagccagatggcccagctcttaatgcaatgttactgtcatgaaagtttcaaaaaaaaaaaaaaaaaaaagctggggtactattctagttgcaaggagacttaaagagacctgacagttaaatggagtaggttgcccttgtttggattctgatttaggaattggacatatagctgtaaagtgtacattcagaaaatttgaatatgagttatataagcattgtattaatgttgcatctcttgaatgtcatcgtgaatggactgccttggaaagtaatgattaattcaccatcacagtagttattcaggcagatttattaatcaggttgactaaaagtcccaactctgattttgtatttattttttttaatttggtatgttaatccttctattcccaaactaaaatctttttttctttttctttcttttttttttgagacagagtctcactctgtcatccaggctggagtgcagtggcacaatcttggctcagtgcaatctccgcctcccagattcaagtgtttctccagcctcagcctcctgagtagctgggattataggcatgcgccaccacgcctcgctaatttttgtatttttagtaaagacaaggttttaccattttggccaggctggtcttgaactcctgacctcaagtgacccgccggcctcggcctcccaaagtgctgggattataggcgtgagccacaatgccagcccaaactaaaatctcttaatttcttttctttttttttttcttttaaagaagtttatttatttgtttttttgagacggagtctcactctgttgcccaggctggagtgcagtagcgcagtcttggctcactgcaacctccgtctcccaggttcaagtgattctccagcctcagcctcccgagtagctgggactacaagggcatgccaccacgcccagctaatttttgtattttttagtagagacgggtttttgccatgttggccaggatggtctcgaactcctgacctcaggtgatccgcccaccttggcctcccagagtgctgggattacaggcatgagccaccgctcctggcctaaaatctcttaatttctaaactaattgattgttactctggaatttcttgattcttcgttattttaaatgtgacgggcagtgacttttcttttgtaggtttggataaatacctcggacattattttggttggtctccgagactaccaggtaaaatttacatgtaaatttttcctattttactggcttgaatttgatgagccatttcttaagagccagttttgtttcaggcattgtgctaggtatcccagggatttatgtttaaatcaaaatctgggagccattattctaggggatacagctgaatgagttaagtgcccatcccacaaaaggctcatagcctggtagtggagagagttaagcacacaagtaattacaatacacatcacaacataggtatgtgctataaatctaaaggagcacttgggaaagaaagaaagtggtggttgcctttcgtgatggtaacccttgactctgtagactcattgtgggtctgtgagatccatttgacatccacctattggaaatcatccctgtatgatactatctctatttgtatagcctcgatcatactttgatttaaaaaaaaaaaaaacccagaataaataatttaaatcttcactttaagccattgtttctcaactgtgggcagttttgccctccgagggacattggcagtgtctggagacttttctggttgtcacaactgggggatgggtgcagtgctgctagcatgtagtagatagaggctggggtgggcacaggacagcatcccataatagagaatggtccgcctcacaataatccatagcgctgaggtgagaaagcttgctttaaattcataccattttaatgtccatttttttcttatgatctaacaataaccccagaaataggaagaataagtaatttcctgttcgatagataaggaaaccaagggtccaaaatgagtaacattttgactgtaaagtgacagccaggaccaacttctgatttgaaattattcatgatctttccgtgcccctcctacttacagggtggtcaatggctcgatagcatcttctggaagcttgttagaaatacaggttctttgactcttcagtcagaacatgcattttaataagatctccataggcttctatacactttacattttaagaagtactggtctgaatcacactgtccttgaagttgaagcaatcaattttctcccttaactgagttaaattattttcaaatagggaagtagaaacattctaaggcagtatttctcaatgggacttttgcatcagaaatacctaaagaacttctcacaatactaattcttgggcttctcttcacatctactaatctgtcttcagaagatataaaagctccacaggagattgtgattgatacctaggcaaagaagcacagataatacagaaaggtataatttccttaggtcattataccagtctcagttcagtctcagttttggaattgcagtgtttgatcaccctgcaaattattgtcccagggaacttttgtacttcaaaagacttctgatcaaagggtaatattaaataatctaaaatatggggtatgcacagttctgctcttattaaagtgagatctctatatttcccaagcttgttaatcattcaggcatgtacataagcttcctcttgggttaaacctaaggatctttttcagagggtatgagaaagctttaaaatttaaaaggagaaagatttatagtaaaacggtgagatttgattgtttattcaatatgagaatttatgaaataactgataatattttgttatgatcagttttttaaagttatttgtctctatttaaggataacaaagctgatgtaattttaaaatacaatgcagacgaagctagaagtctgaaggcatacggcgagcttccagagcatggtaatgtctgagttactgtattaacttgtcatatggtatttaggttatgtgttgctggttaggtgaaggaactatggattttgcttatttactttagtgctcacatttttagttttaagtatgcctgcctatgcttcataatactagatactataagaaagaaattactggaattctgttcctaataaatatggtgaggagttctgtaagctttggacttccacataatgctaactaaaggaataattttgttatagtatctattaaaattccttcctcgagagactgtcagtgcgcatatgggttaaacacgaagtgcaagtcagccgggcatggtggcacatgcctgtagtctcagctacttgggaggccaagacgggaggattgcttgagtccaagagttcaaggatgcagtgacctatgatcatgccactatactcgagcctgagtgacaaagtgagaccttgtctcaaaaaaaattaaaaaaaaaaaaaaaaaaaaaccatgaagcaagggcaagtaattaggtacagttactgattttgtttgtttgttttgaaatggagtctcactcttttgcccaggctggagtgcagtggtgcagtcttggctcactgcaacctctgcctcccaggttcaagcgattctcagcctccaaagcagctgagattacaggcatgcaccaccatgcccggctaattttgtagttttagtagagacggggtttcaccatgttggtcaggctagtctcaaactcctgacctcagatgatccacccacctctgcctaccaaagtgctcggatttcaggcgtgaaccaccatgcccggcctcattactgatttttattaaaaagttatatttccattttatcgttgtataatagtatcccataggattttttaaaagcaacatttcttggttttcacccttccaaatacaaaagtaatgaattcttaacgcagaaaacctaaaaataagtcccttataacctcatcaaaggggaaatgtacttgacatactgttctgtaggcctgcattttcacttggcagttattatttttggctctgttgtatcttaagaaaaaacataattttgttatattttacttaagcatgaaagtcctgctgaaattacttagcatttctgatctaagaaatgttaatgtatataggaataggactagcgcttcctggttcattttcattgcttaggggtaatcatgatttgaccagatctttctgattgatgagtctatctgatgattagtgaaccagctattcttaaggaaatacgttgttaccatatttccttgtatgttgagaagtatacctgaaagttataatagcttcagaattagtgtaattagggccttccttactaaaaatacctttgcaaacaaaagaaaatggtaacacagatactcccatcttgacttagcagtgacactgcaggaattttttttcataaaatattctttatagttattgtcttatataaaaggaatgctcttatgatgaaactttgagtaaattacagtgctgacttatgagtatttcttactgtgtccttagctaaaatcaatgaaactgatacatttggtcctggagatgatgatgaaattcagtttgatgacattggagatgatgatgaagatattgatgacgtaagtagatgtaccttgtgttttccaatttttgttattatccatggagaaaccaactttcccctaacatccattaattttaagaacatgggacacttaaataaggttgtattttgagaattgtctgaattaaataatattatttagaagacacctggtcaaactgtttatattttgagaattctttttttttttttttttttttttttttttgtgatggagttttgttctgtcacccaggctggagtgcagtggtacaatctcagctcactgcaatctctgcctcctgggttcaagcgattctcctgcctcagcctcctgaatagctgggactacaggcgcgtgccaccacgcctggctaattttttgtatttttagtagagacgaggtttcaccacgttggccaggctggtctcgaactcctgacctccggtgatctgccctcctcggcctcccaaagtgctggggttgcaggcgtgagccaccatgcccggccctattttgagaattcttataaccctcttcaatttctcttcctgaaaaggtcagtgtttgcattggcaatattaacgccagccactctaatcataacttgtttaattaagagtctctaaagagatagccattaagaaatttagtggacagttgaaaaatagatcttatcaaaggaacatgcctttttaattgaaatattagtgtgttgaaagaatcttgtttgaaccagcttgatatgaagcattggaattacaacatacactgaaagccttgtcaaaatggaagcctattgccaattatggtatttttagctgttgggtgtgtactgttggcaaactcttggtttgcagttggtatgtttattttgaggaaaatggattgtctttcctaataataaagtagtaatgcccataagtgtaaatgctttactgcacttctgctgttactgtaattgaatgaaattcaaacttaatcttttggcagtataaatttatttagtgattagggtgttactcttaaatctgttttgggctcttcttttcaaacctcttttaactaaaatgtagttcagaaaccacctgtgtatttcaacccaaaaacaataataagtcagatgtggtggtatgcacccatagtcccagctactcaggagactgataggggaggatcacctgagcccaggagttcaagaccagcctgggtaacatagccagactttgtctctacataaataacataataacgttaaatttgatgcaaagatggaatttcggaatacctagagcagttgttcctgaccaagaatactcacactgtgagttaaattactaatattatagacattttaacatgtacacaaaaataggaagtgagaaataaacatgttgttctgttattttcttaattttggagaccctgagccaagaggagtcttacgactaaactgttactaatattttgacaatagaattaacaattctattctttggtaaataagagcttgcagctgacatgtggattaagcgccaacccaaacattttgacatctgagcaggggtagaaggcctctttaaaaaaaaaaaaaaattaaggaacctaaccagagaacatgcatggatatgaagccgcatgcaccaagataatgggttgagaatctaggcgtggtcaagattttctcagtaaaaatttctggatctgggccaacgcctcctcagaactggacccagctggctggctggaaaagggatggtaaagagtgattattaaaggagttctcttgaacattttgtaaaagttggctctgtcacctgagaaccctactctttgagacatttctccaggtggtttatagatgttttaactataaccagattgactcaggagaattaggtcagtatcacactgaacgggatcaatcatatcatgcttcctgtgtctgctcccatccatgagatacaaaaatctcaaattacaagcattaaaggaaggagacagtaaattttattaagaatattttgcataacatgtaacattacaaaggagatcatcacgatttacttatagcaggccagaattataggaatttcttcttcaaactggatttgtttctcacatagcctaaggaggtgaaagtctcccttatatatggagtagactgttggaatataagaattctttttcctttcatctgatgttcttttcccttccagatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgt

SEQ ID NO: 4413 - DNA, 13748 bp, human
cgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaatgccgcccggacccccggaccacggctctgctcggccgggtctcccaggtcctgcccgtagattgcaggtcacccaggccgcagtgaccctttttccttcccgccctgcctgcccgcggctgggcgccccacacgcgactctgagctcgggagaggagctgggaagttaactcctgttgcccagtttggtcacattggggtggagccggcgccatttttgtagggcctcctgcgggagaatgtgggcttttgctcctgattcgcgccagactgaccgctgctcggtggggacggtggcgggaaccttccccggggcggcctaggtttagtagataggcccctttggccttcccgggcatgaggggttataatccctggaagccgttctgaactttcagagtgctgtctgcattcgtgagcaccaggtactcctgcatgggtttctttatggacagttcagtattgttgaggctactcgctgtcccttgtgaacagtgggtgaaaccttgatacatttctaaggctcacctctagagatttactctctccatccctttacaggatatagcttatgtttgtttgctgaagacttattccatattgagccaagttttctacttttgcttcagatgatgcatatgttgtgagaataaagacctaatttaagtgtcctccattctgaggctaagcgttcacaaatgatcagacttgaggataactttatttgggatttccaaaacggaaggcctaatcttaaaaaaaaaaaaacaaaaacaaaaaacagaacactcctaaagaaattacttttatagatttacagtgttcctgtcatttttaatagccgtataacttgaagaaaattgtgcaagtaaatatagggaaaatactgtattttcctacaggagaggagcatacttcatagtccgtaagtagtctcctttgattattcattctagaggaaaccctcccctgacacaggcctacttctgctctcttttctacttgacagctggctccagggattctaccacatttcctctttgtagctgtcacttattactttatcccttagggtacttggtcgaggtgttctgtgcacaagttggtgcagtcactgctcattattttggaaaagatggagttataaacaaaaaattttaaagtcttacagttttcttctgtataatcctttattctctctgaggtggtaaggggatcacttccatcttattctcacctttatttctagtaataagatttccaattcttccaccaggctgtaagctctacaaggcaggaatagtatctgtcttaatctcattggattgccagcacttgacaattagtagatgcttaataaatatttgttggtttaagtcacctacctcctgtcgactccacccttagtgaataataggttctgctttggttccaaggggataggacttctacactaaatcacatctagttccctagcctcatgtcttaagaaagagcctctctgggaatttctccaaaacaactctggtttaaagaatgttgatgtcactttaattgttgtacactcagacctagtctcattcattcaacagagaatttaaagaacatcccattacatggcaataaaatacaaaggggagtgatccgggtatggttaattctggtaaattgacaagtaattagtcttttcttaaataacatttgaggcatacaaaaaatacagctaacatgatatacctgggaacccattactctgaatttaagaattacagcgcagattgaggtaaagccctaatcaccttttactctctttttggaggtaatcaccaggctgagtttggtgtttatcattcctgtactgtctgaaaccaatcagttcttagttatcttacttagaggaatggtacttttcatgacctaatttaagtgtcctccatttttttttgctgcttccaagctcttcccatgagtctcttagggtcattaccacttacagcctttttcctgccttttggaaatggctgccaatgtggtttcctttctggaatgggagcaaaatgctgtggagaggtaagcttatgtgggggctaggggcaaaaaaaacattgtgactttggtcaccccagcttactgactgtaatcagtgaactgatttactcactgaagctaagcgacttacttaacttctctgagcttcagggaactcatgggtaaactgggaataaatgaatgttatgacctcatggggtgattgtgacaagtaaatgggcagaattattgcatagtggttaagagcatggtcactggggtcatataatagaaacagggatgttgagtagggaccagcattataaaagaaagtaaattgggtaccgaacagatcttctttattttttaagagacagtgtctcgctatgttgcccaggctagcctggaacctcctgggcttgctcaagtgatcctcccacctgagcctcctgagtagctgagaccctaggcgcacaccactgcacccagtgagatttcaatatttatggtactctgctaccaaaagtttgaaaaccacagttctctgtccagacactgtcttcacttaattttgaaagtatcgggttccttgcatagggcctggctttagaagacacccaagatttccgcttagaagaatatgtatagaattgcatttttatttcaaaaggatgggtgctaaagtgaaatgtttttctatattttttaacataatatctgctatttatgtgtattttatgtcagaaaaatccccaaaggaaattccaagaagggtagggaggtgataatgtgttaatgttgggattggagattgtaaatttaatatgattgtgtagctaaaatagatgaattttttaatttaagtgatcttttaaaaaatggttttataagccttaatttcattttatttcatactgttttacagataattaatgtcatttacctccttttcttttttttaaaccatcaggtaaaggaggtaaaaacagacgcaggggtaagaatgagaatgaatctgaaaaaagagaactggtattcaaagaggatggtcagggtaagtgttttcataaattacgctttttaaaataacatcctttcttttttagctggggactttatttttttgagacagcgtcttgcccatcgcccagggtgaagtgtggtggcacgattacagcccactgcagccatgacctcctgggctgaagcagtccttccacttcagcctcccgagtatttgggactacaggcacacaccaccacgtctggctaattttaaaaatttttttaggctgggcgcagtggctcacgtctgtaatcccagcactttgggaggccaaggcgggcggatcacgaggtcaggagttcgagaccagcctgaccaacatgatgaaaccccgtctctactaaaattacaaaaattagctgggtgtggtggcacgtgcctgtaatcccagctactcaggaggctgaggcaggagaattgtttgaacctgggaggcggaggttgcagtgagccgagatcacaccactgcactccagcctgggtgacagagggagactctgtctcaaaaaaaaaaaaaaaaaaaaaaaaaaaactgtatagagatgaggtcttcatatgttgccctggctattctcgaactcctgggctcaagtgattctcccaccatgacctcccaaagtactgggaactaagaatgtgtcgtatagttcagagggaattgagctatggttgacagttctgtgatttagttggcagttctatgattagcatttctggtagtgaatggtacatataatatgttgagtagaccatggacatttgaaggatgagcctgaggcccttatagacctctccattctccagtgccattagcatataacttcgtaaactacaataaaatgaaactgaacagttaactgattttattagactgaagaatattgtaagtgccagaccaagatacatagcactagtcaaataaatcctaactggatcgtttgccctttcctgttacttttatttcgagtcatttcaaacctacagaaagttgcagtattagtgcaacaaactcccttaaatccttcatctgtacacacacatataaagaaatatatatgtgggattttttaattttttttttgagatggagtctcgctctgtcgcccaggctggagtgcagtggcgcgatctcggctcactacaagctccacctcccgggttcacgccattctcctgcctcagcctcccaagtagctgggactacaggcacccgccaccatgcctgggtattttttttgtatttttagtagagacggggtttcactgtgttagccaggatgggtctcgatctcctaacctcgtgatccacccgtctcggcctccgaaagtgctgggattacaggcgtgagccaccgcacctagccccatatgtaggatttcttcaggaccatttgaaatttagagacatcatgttacttttcccttacttgatcatgtatcttctaagtgcaagtatattttcttatataactagaagagaattatcacactcaggtaatttgacattgatataatatctagtatatactccatatttcctcaggtattccaattatttccagtactttagcttttaatagaactttgggtggatttattacgccatacatataaaccagtaaacatgagatacgttttctggctaaaagtcctttggtttcttagccttggtcatccttgcctctaaaatagcagctgacttgacttgggcatacactgttttattattactttttccctcacttcagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgtgtgcacgcacacgtgtttataaaggtagcagttgtaggaatgaatgagattgggggtgagggggtgcatatgtatgtctatgaaagcctaatcatttctgggcaatgatgtaaaggttttacgactgacctttgtaactatgaagttttctacacttgacctgagctcagaaaaaagaaagaaagaaagaaatgtcatcatagagtcttagttctagctctgccgttaactaacttgatgtttatcactcccttatgtttgtttatagttttactatatgtatttattcccaactggtgcaactttattctcttgacagttttatgtggactttaagttgctgttatcaaaagttgaacaatattccatacccttttcctttctccccgctagagtatgctcaggtaatcaaaatgttgggaaatggacggctagaagcaatgtgtttcgatggtgtaaagaggttatgtcacatcagaggaaaattgagaaaaaaggtaggtgtgatttgttttactttaatataaaattggttaagggggaaaatccctctacagtttttaactgtccatggacttcatttttggaaattcccaaaagacttaccttggtaaacagtgatttacctataagtaaaatagcaaggtctgtaatggtaattttatacaggttctaatgttaaagaagcatttgtatcacttgtattgtattcctgcccaaaaagtccaaattgagagacattctgcaaaaacaaacggcccagttttttttttccttgtcttttttttgatacagggtctcactcttatcacccagcctgtagagtagtggcatgatctgggctcactgtaacctcaccctcattggttcaagtgatcctcccacttcagcctcccgtgtagcaggggctacaggcctgtgccaccatgcctggctaatttctgtattttttgtagagatggggtttcttcatgttgcttaggctggtttcgaatcctcagctcaagcaatcagcccaccttggcctcccaaaatgctgggattataggcatgagccactgtacccagccagatggcccagctcttaatgcaatgttactgtcatgaaagtttcaaaaaaaaaaaaaaaaaaaagctggggtactattctagttgcaaggagacttaaagagacctgacagttaaatggagtaggttgcccttgtttggattctgatttaggaattggacatatagctgtaaagtgtacattcagaaaatttgaatatgagttatataagcattgtattaatgttgcatctcttgaatgtcatcgtgaatggactgccttggaaagtaatgattaattcaccatcacagtagttattcaggcagatttattaatcaggttgactaaaagtcccaactctgattttgtatttattttttttaatttggtatgttaatccttctattcccaaactaaaatctttttttctttttctttcttttttttttgagacagagtctcactctgtcatccaggctggagtgcagtggcacaatcttggctcagtgcaatctccgcctcccagattcaagtgtttctccagcctcagcctcctgagtagctgggattataggcatgcgccaccacgcctcgctaatttttgtatttttagtaaagacaaggttttaccattttggccaggctggtcttgaactcctgacctcaagtgacccgccggcctcggcctcccaaagtgctgggattataggcgtgagccacaatgccagcccaaactaaaatctcttaatttcttttctttttttttttcttttaaagaagtttatttatttgtttttttgagacggagtctcactctgttgcccaggctggagtgcagtagcgcagtcttggctcactgcaacctccgtctcccaggttcaagtgattctccagcctcagcctcccgagtagctgggactacaagggcatgccaccacgcccagctaatttttgtattttttagtagagacgggtttttgccatgttggccaggatggtctcgaactcctgacctcaggtgatccgcccaccttggcctcccagagtgctgggattacaggcatgagccaccgctcctggcctaaaatctcttaatttctaaactaattgattgttactctggaatttcttgattcttcgttattttaaatgtgacgggcagtgacttttcttttgtaggtttggataaatacctcggacattattttggttggtctccgagactaccaggtaaaatttacatgtaaatttttcctattttactggcttgaatttgatgagccatttcttaagagccagttttgtttcaggcattgtgctaggtatcccagggatttatgtttaaatcaaaatctgggagccattattctaggggatacagctgaatgagttaagtgcccatcccacaaaaggctcatagcctggtagtggagagagttaagcacacaagtaattacaatacacatcacaacataggtatgtgctataaatctaaaggagcacttgggaaagaaagaaagtggtggttgcctttcgtgatggtaacccttgactctgtagactcattgtgggtctgtgagatccatttgacatccacctattggaaatcatccctgtatgatactatctctatttgtatagcctcgatcatactttgatttaaaaaaaaaaaaaacccagaataaataatttaaatcttcactttaagccattgtttctcaactgtgggcagttttgccctccgagggacattggcagtgtctggagacttttctggttgtcacaactgggggatgggtgcagtgctgctagcatgtagtagatagaggctggggtgggcacaggacagcatcccataatagagaatggtccgcctcacaataatccatagcgctgaggtgagaaagcttgctttaaattcataccattttaatgtccatttttttcttatgatctaacaataaccccagaaataggaagaataagtaatttcctgttcgatagataaggaaaccaagggtccaaaatgagtaacattttgactgtaaagtgacagccaggaccaacttctgatttgaaattattcatgatctttccgtgcccctcctacttacagggtggtcaatggctcgatagcatcttctggaagcttgttagaaatacaggttctttgactcttcagtcagaacatgcattttaataagatctccataggcttctatacactttacattttaagaagtactggtctgaatcacactgtccttgaagttgaagcaatcaattttctcccttaactgagttaaattattttcaaatagggaagtagaaacattctaaggcagtatttctcaatgggacttttgcatcagaaatacctaaagaacttctcacaatactaattcttgggcttctcttcacatctactaatctgtcttcagaagatataaaagctccacaggagattgtgattgatacctaggcaaagaagcacagataatacagaaaggtataatttccttaggtcattataccagtctcagttcagtctcagttttggaattgcagtgtttgatcaccctgcaaattattgtcccagggaacttttgtacttcaaaagacttctgatcaaagggtaatattaaataatctaaaatatggggtatgcacagttctgctcttattaaagtgagatctctatatttcccaagcttgttaatcattcaggcatgtacataagcttcctcttgggttaaacctaaggatctttttcagagggtatgagaaagctttaaaatttaaaaggagaaagatttatagtaaaacggtgagatttgattgtttattcaatatgagaatttatgaaataactgataatattttgttatgatcagttttttaaagttatttgtctctatttaaggataacaaagctgatgtaattttaaaatacaatgcagacgaagctagaagtctgaaggcatacggcgagcttccagagcatggtaatgtctgagttactgtattaacttgtcatatggtatttaggttatgtgttgctggttaggtgaaggaactatggattttgcttatttactttagtgctcacatttttagttttaagtatgcctgcctatgcttcataatactagatactataagaaagaaattactggaattctgttcctaataaatatggtgaggagttctgtaagctttggacttccacataatgctaactaaaggaataattttgttatagtatctattaaaattccttcctcgagagactgtcagtgcgcatatgggttaaacacgaagtgcaagtcagccgggcatggtggcacatgcctgtagtctcagctacttgggaggccaagacgggaggattgcttgagtccaagagttcaaggatgcagtgacctatgatcatgccactatactcgagcctgagtgacaaagtgagaccttgtctcaaaaaaaattaaaaaaaaaaaaaaaaaaaaaccatgaagcaagggcaagtaattaggtacagttactgattttgtttgtttgttttgaaatggagtctcactcttttgcccaggctggagtgcagtggtgcagtcttggctcactgcaacctctgcctcccaggttcaagcgattctcagcctccaaagcagctgagattacaggcatgcaccaccatgcccggctaattttgtagttttagtagagacggggtttcaccatgttggtcaggctagtctcaaactcctgacctcagatgatccacccacctctgcctaccaaagtgctcggatttcaggcgtgaaccaccatgcccggcctcattactgatttttattaaaaagttatatttccattttatcgttgtataatagtatcccataggattttttaaaagcaacatttcttggttttcacccttccaaatacaaaagtaatgaattcttaacgcagaaaacctaaaaataagtcccttataacctcatcaaaggggaaatgtacttgacatactgttctgtaggcctgcattttcacttggcagttattatttttggctctgttgtatcttaagaaaaaacataattttgttatattttacttaagcatgaaagtcctgctgaaattacttagcatttctgatctaagaaatgttaatgtatataggaataggactagcgcttcctggttcattttcattgcttaggggtaatcatgatttgaccagatctttctgattgatgagtctatctgatgattagtgaaccagctattcttaaggaaatacgttgttaccatatttccttgtatgttgagaagtatacctgaaagttataatagcttcagaattagtgtaattagggccttccttactaaaaatacctttgcaaacaaaagaaaatggtaacacagatactcccatcttgacttagcagtgacactgcaggaattttttttcataaaatattctttatagttattgtcttatataaaaggaatgctcttatgatgaaactttgagtaaattacagtgctgacttatgagtatttcttactgtgtccttagctaaaatcaatgaaactgatacatttggtcctggagatgatgatgaaattcagtttgatgacattggagatgatgatgaagatattgatgacgtaagtagatgtaccttgtgttttccaatttttgttattatccatggagaaaccaactttcccctaacatccattaattttaagaacatgggacacttaaataaggttgtattttgagaattgtctgaattaaataatattatttagaagacacctggtcaaactgtttatattttgagaattctttttttttttttttttttttttttttttgtgatggagttttgttctgtcacccaggctggagtgcagtggtacaatctcagctcactgcaatctctgcctcctgggttcaagcgattctcctgcctcagcctcctgaatagctgggactacaggcgcgtgccaccacgcctggctaattttttgtatttttagtagagacgaggtttcaccacgttggccaggctggtctcgaactcctgacctccggtgatctgccctcctcggcctcccaaagtgctggggttgcaggcgtgagccaccatgcccggccctattttgagaattcttataaccctcttcaatttctcttcctgaaaaggtcagtgtttgcattggcaatattaacgccagccactctaatcataacttgtttaattaagagtctctaaagagatagccattaagaaatttagtggacagttgaaaaatagatcttatcaaaggaacatgcctttttaattgaaatattagtgtgttgaaagaatcttgtttgaaccagcttgatatgaagcattggaattacaacatacactgaaagccttgtcaaaatggaagcctattgccaattatggtatttttagctgttgggtgtgtactgttggcaaactcttggtttgcagttggtatgtttattttgaggaaaatggattgtctttcctaataataaagtagtaatgcccataagtgtaaatgctttactgcacttctgctgttactgtaattgaatgaaattcaaacttaatcttttggcagtataaatttatttagtgattagggtgttactcttaaatctgttttgggctcttcttttcaaacctcttttaactaaaatgtagttcagaaaccacctgtgtatttcaacccaaaaacaataataagtcagatgtggtggtatgcacccatagtcccagctactcaggagactgataggggaggatcacctgagcccaggagttcaagaccagcctgggtaacatagccagactttgtctctacataaataacataataacgttaaatttgatgcaaagatggaatttcggaatacctagagcagttgttcctgaccaagaatactcacactgtgagttaaattactaatattatagacattttaacatgtacacaaaaataggaagtgagaaataaacatgttgttctgttattttcttaattttggagaccctgagccaagaggagtcttacgactaaactgttactaatattttgacaatagaattaacaattctattctttggtaaataagagcttgcagctgacatgtggattaagcgccaacccaaacattttgacatctgagcaggggtagaaggcctctttaaaaaaaaaaaaaaattaaggaacctaaccagagaacatgcatggatatgaagccgcatgcaccaagataatgggttgagaatctaggcgtggtcaagattttctcagtaaaaatttctggatctgggccaacgcctcctcagaactggacccagctggctggctggaaaagggatggtaaagagtgattattaaaggagttctcttgaacattttgtaaaagttggctctgtcacctgagaaccctactctttgagacatttctccaggtggtttatagatgttttaactataaccagattgactcaggagaattaggtcagtatcacactgaacgggatcaatcatatcatgcttcctgtgtctgctcccatccatgagatacaaaaatctcaaattacaagcattaaaggaaggagacagtaaattttattaagaatattttgcataacatgtaacattacaaaggagatcatcacgatttacttatagcaggccagaattataggaatttcttcttcaaactggatttgtttctcacatagcctaaggaggtgaaagtctcccttatatatggagtagactgttggaatataagaattctttttcctttcatctgatgttcttttcccttccagatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgg

SEQ ID NO: 4414 - DNA, 54262 bp, human
tttccaccattagcgaggcctcacacccggcgctccaagttcggggctggaggcgtcccggcttcctccctcccggagcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaaggtgagggcgcccgccgccacctgcgtggccatccccgccgctcccgccgcctggcgggctggggcgggggtcgggcgtggcgtgcgccgcgggccgaacaatgcgggcggcccgcgcggcgccgcactctcccggactgccacgcacagcgcgctgcggggccgcgtgcaccggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcgggtaaatttccctcttgggggcgggggtttcccctcgtagggagctggggctggggaaaggtctgcggacgcgcagcgcttgcagaattctcagccgactgcgtaggagacggatcccccggaaaggaactgggggacgggaaaaggaaacgattattattattgggggtggggaggcatgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgattttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatcttgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttgcagtggaggagttaccaattgggaatcttctcatccccttagtatgtaatttactccgttttgtttgaattggtagtttcaggccttagctaccttctcaggagataaagattaaaatgctgtgttctctaatagctttaaaaagttagagcttttgattttggatttcatacccagaagattggagattatgggctttataattgcgatcaccatggttatgctaacctttcacagataaggattagttataaagttactagcatctgtttaaaaacgtcaataaagttcttagtttagtttttggagtctgcatattccaggtgttttaattcactatttcactgcagttgtaacctaagcctgctggtgtgcactgtggctccgaccaccatttcatggtatagactcagttcttttgaaaagtcagaaaacctcctcaattgaatctgcgaaccacgtatgtaaaccatgcacaaatgctctttaaaacccttacagctaggcacttttccagaccccaggaaaaacaaccctgcggccctgaggtgtggtgggcctgggtttcattaaattgacactgtcatctgtgttccggaaggagccaccgagctagctagtggtgatactggtgataaatgtgtttacgtgctaagccacagattcaaaaggagctggtaagagccagtagcatgttctagattcctgaactgacttgactctgggtagttttacacacaccttaatttttccctctccatgaaggtgctaatgatactaaaatcccacacactgtgtcgttgggtggaatgtccaataaaatgtttggaagagtatcaaatgatacataaaatacctaacactaattgcaatacttagggcagagtactttgaaattgtgccagtggataaagatgctcagttataaagaggtgtgaatttaacttacttgaagggtaacgaaagctctgctggcaagagaagaggcagaaaataatgggttgccctgtgttttgaaggttggtctactttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacaggttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactgatttcgagctcctggactcaagggatcctccagcctgagactcctgagtcactaatgttactggtgcacactgcagtacctggctgaagttttataaatggcttaacactgaatcttttaactgtataaggcagtagctaagtggcccagttgcatgtggaattttgaggaagatggtcatgggtttctcagtccaagtgtttgttcctacgtgggggtttgtctaatttggagctggaggcttgatgttgagaagagagaggaaagagcttactattaactccctttggtatgagatgcaagaatatgacaggactttttttttttttttttttttaatttgagttctgggatgcagtacagaacgtgcaggtttgttacataggtatacatgtgccatcgtggtctgctatacctatcaacctgtcatctaggttttagaccctgcatgcatttgtcctaatgctctccctccccttgccccccaccccctgacaggcccaggtgtatgatgttcccttccctgtgttcatgtgttctcattgttgggctcccacttatgagtgagaacatgtggtgtttggttttctgttcctgtgttagtttgcctagaatgatggcttccagcatcatccatgtccctgcaaaggacaggaactcattcttttttatggttgcatagtattccatggtgtatatgtgccacattttctttatccagtctatcatagatgggcatttgggttggttccaagtctttgttattgtaaatagtgcttagtaaacatacgtatgcatgtgtctttatagtagaatgatttataatcttttgggtatatacccagtaatgggattgctgggtcagatggtttttccggttctagatccttgaggaatcaccacactgtcttccacaatagttgaactaatttacattcccaccaacagtgtaaaagcattcctatttctccacacctctccagcatttgttgtttcctgactttttaataaggaccattctaactggcatgacatggtatctcattgtggttttgatttacatttctctaatgaccagtgatgatgagcttttttcccatatgtttgttggctgcataaatgtcttcttttcagaagtgtctgttcatatccttcacccactttttgatgaggttatgtttttcttataaatttagttctttgtggattctggatattagagctttgtcagatgggtagattgcaaaaatgttctcccattctgtaggttgcctgttcactctgatgatagtttctttagctgtgcagaagctctttagttgaattaaatcccatttgtcaattttggcttttgttgcagttgcttttggtgtttttttgtcatgaagtctttgcccatgcctatgtcctgaatggtattgcctaggttttcttctagggtttttatggtttggggttttacatttaagtctttaatccatcttgagttaattttttgtataaggtgtaaggaaggggtccagtttctgttttctgcatatggctagccagttttcccagcaccgtttattaaatagggaatcctttccccattgcttgtttttgtcaggtttaggggctttttttttttttaagcattttgtgactgctaaatttttagtggagttcctgtaatttatttctttgaacaaagggtctggctttgcttcagaaggctgcaggaactgttcaagtagtggtttgtgcatttgtctttttactacatctgctcattttacactatggggttagggaaatgtaaagaaagaggggatacaactgtgatactgtcacaagtagataaccactttgatgtgtggtacaaatggcttgcttattcttgttgcatatataacaatgttgtacgtaaaaacactggattttggagcccagctgttggggtttgaatcctggttccactacttactagtgtgtgtgaccttgggcaggttgttaatctatgtgccttactgtgctggctatactttggttacccttgaatagcagctgtgagaacagacatccttgccttgtttttggaccttatggggagagcagtcttttaccattttgagtattatgctaactgtaggttttttgtagataccctttatcaagttgagaaagctctcctctattcccatttttgtgtgtttatcttgaatgagtgttggattttgtcaggttcttttttgcataaattaatataaaatgtgggtttttttctttaacctattatggtggatcacgttgtttgtttgtttgtttttttttttttttgaatgttgaactagccttgtatacctggaataaatctcacttggtcatggcatatttttctatattgctgaatcctatttgctaatgattttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaattttcgtatttttttttagagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaactgggttttcttgcatacaactgagtttctgcttacacattctttaatttcttttaattcctatttcattagtttgtgtttttagaggaattgccccatttcattcttaagttgccacatttatgtgtgtagagttgtagtattcccttatcctgttggtgcttgcagagtatccacagtgatatctcctgttattcctaatattggcaatctggttttttttctttgtaagtcttgctagagtttatcttaataatcttttcaaagaaatagctctttgcttaatttttttctcctctagtttttatcaattttattgatttttttttttttttgctgttatccttctctttttgctttggacttttctctttttctaggttcttgaagtactagtgtggattaggaatttgagattttaaagtggaattcggtactcttaagtattctcattctctagtatgcagtttctgttgatactagttgataatgttcgacgtattccttaaaaagcaagagtcttagttatgttggttgttagctgttcttttttcaacacaataaattgctaacttgaatataggaaatattcctcagattattctagtttcaaatgctaagaatgttctgaagtccttggaccagattctgctcatctggcctgtttttgtgtgaccctccagctaagaatgatctttacatcttaaaagggttgtaaagcacacacaccaaagaatatgtgacagaaacctgatttagccagaatgctttaccacgtggccctttacagaaaaagcttgcccgttcctgcctttagaccatctaggtgcaatgattttgattgcccgtttcagagccatctggaaaaatttggaagtacagatttccaagcccttcacatggctgccttctcgtctggaatccatcatagtgcacggccatctctgtgtttgagtagttttgacttgtgtcctctgtctttcatctttattctccagtggcacttacttgtccagcacctcctaggtgctgagtaatctccttgggggcccagttgaatgtggtcttggctaatatactctggtaaagccacaggaagggaaggcagagggacctcctcagcgacatgtgtatcaagtacggtctaatataaatgtgatatttttttttgacatcacacaattcccaaagtccagactgttttatctttggaaatgctatttcattgttgatacacagcctggcatagatgctcagacagaacccttgaagtattgtttttttttgagacagtcttgctctgttgcccaggatgaagtgcagtggcgtgatcttggctcacggcaacccctgccttctgggttcaagggattcccttgccccagcctcccgagtagctggtattacaggcacccactaccacagcgggctaatttttatattttagcagagacggagtttcaccatgtttgtcaggctggtcttgaactcctgacctcaaatgatccgaccgccttggcctcctaaagtgctgtgactacaggcgtgagccactgcgcccggccttgaattatttttaaacacaaaaatggtatgacctgtaagggattctgcccggttaaggttagtgagaagaaagctggatgttcatgatagtgctacagtgctcagaaagcatatttcatccttcccagataataaaactggcaatcccatggtttctactttggcaaagaaatcttgtttccccttctggacggagctaaaggaaaccattgtcatttgaccagggccaacctgtgtcctctgtttcagcctgcccctctgtgatgagggggtgaatgtaggttggtggctggggccgtctccacacgtcacatgccaattttgaactaaaagtaagggctggtcactttacctggtccagatgcattcctgagtcatctcctgttccctgacctcaaacactgcaagtcccctctcaaaaccttctttttgttacttctctaacttctcctttctgttgggttgtagcatgacccccaccccctgcttttctgtgggttctgatctcttttcctaatcctctgccttggttctcttccaccgctctgggccagagttccttcctcttctcaaaaaacatggtccttaagctgacggggcccactgaagagcatcgtaggataccttacgttgtttgcatgattcctttcaggagaggtcaagtggcctggttattcagtgtctcatagccacaaactaatggataatattccttccagatgaaaggcaggctttagtatactgtcttttgtctgtgccttgttttctgagtcttgactctcatacgggttaaatcagaagggtgaggatgggtgagtttgaatcacttgacaaccagcaagatgctgccctccccagtcccagtgtctgtgggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactactttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctataacctgatggaagtttgggtcgtttctactttctggctattgcatatcatgctactgtgaacatctgtgtcagcttgggttgtgtgtcatgagcttcatttcatcatcatgcagctgttgtaaaaaggactagacatagggctataaagccaagctgttaagtaaggcatgccaaaggaccacctgcttgacctagaaattcattaagcttctaatatctgagaagtctaataggcagatccttttttaaaattaagttaaacttttaattgtaaactagaattttcatttgtgaaattgaagtcttttttgcatatcacttgatttctgtaatctggacctgctgcctgtcagtcttcgtgcttttgatggacttagcacattctgagttcagaagatgctctcagacccttaggcagtgctcagccatgggcttgggtgaaaaggagacttgagggatgccgcgctctttgtcattcttttcagaggggttatgccagtggtgttggtgacttctgaacagatacttctttaacttggtataatttatgtaaattttagtgtaccagttctgagttttgaccaatgcatacagttgtgtaaccaccactagtatcaagattagaaacatctgaacgtggttttaaagcagctacctgatttcaaattggattggaatccagtttcctttcctcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgggttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccgggtcagaagaatgagtttctccaagacgggcctgtaaatggttccctggtagaaaatgaggcaggagggtgaagcttaggccttgattcttttttttcccttcctgtcttcccttcccttcctttagtagtggtgtatttaatttggaccagtttattcattttaagttgttgttgaacaaacacacaaagtaggcagtgggctggaaatggggacattgcgttgttcagtagacaaaggacacgttttgccttgggagaggtcactgtgtttctgagcgctttggaaggctgactgatctactagttacaatatgttgttctagcctggccattgaagtgaattttcagagaacttctgccaaagaagaacatttcattggcctaatttggatgactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaagttccatactagacaggcataaaggttgaaatttggaataattacaaagcattttctggggcatgtgacaggttacccatggcttcagttagtaaagagttctaacttttttcagcccctctgttgagcattttctataactttttggtgagttgagtataactggtatggaaatggtagggggtttcttttcctttttttgtgttgggtgatttagattagtggttctcaactgtggctggacattggaatttcccagggagcttttgaaaatactcatgcctggggcccacccccacatttctacttaattggcctaatgtgtggcattggaatttttaaaaattcctcaggtgattattattacttatttttttgaaatagggtctcactgttgcccaggctgaagtgaggtggcacaatcatgggtcactgcagccttcacctcccaggctaaggtgttcctcccatctcagcctcctgggtagctgggactataggggcatgccactatgtccggctaatttttgtatttttggtagagacagattttaccacgttgcccaggctggtctcgaactcctgggctcaagcgatcctcctgccttgacctcctaaagtgttgggattacaggcatgaaacaccatgcctggcctccctgggtgaatgaaaatgcacagctaggattgtaaaccactggtctagatgtttttgaacctctgcaaagatacagtaataaaggatgatgaattcagccaaataaaataattttttatttgccaccaaacatttattgagcacctgggatcaagatgactaagtgagccacctcatgcttttgctttgttttcactttaaaagccctgatttggaaagagatactactgcggagttttcagctctagctccccttcctggagtgtcttccccaagggctgggtgacagggaggccccaaatcaggaggaaggtgaggatgaagggagatgaatggtgggcaaaatggtggtgtccccataaggccctgcagacaccttcctggcagggctagcatactcagatgcccacagggaccaggcggccgcacaaatgaatagggcttgtgggtaaatgagcttccagaaacacgttcagctttggcctgtttttactgaacttggcgggtaagcctatagtgtgggaacaagtaatacttcaaatcggatttcttgtgtagtttttccttcagtttgaaacctggccggaggactttctttagcccacacggtgcctttctgttaattgtgccagttagaaaaaggggatggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaaggagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgactttcccaaaggcacagttttgctaggaacaaatgagagcttaaggattcattgggccaccgctgctcggtgtttatagatgcttgtgctgctgtgggagtgtgacatggattctgcgctggtagtttctccctgatgtgggactttttcttggaggctctttcattttggccatctgtagggcttgaccaccctgacatccagccctacccaagtccttgcaagtttcagctgcatcctcactttggctagccagacccctgcattctgagggggaggaaaccacttctttgggggtgaacacctgttggtgacttttggaaggggttgctctagttcttagggctgtctgaagtcccgttgctttttctcttcttcctatctcaattgctgataccccaagggtctcagggctgtggcccatttatttctacctatacctgtttggggatttagggttacactctgtcatctagttttgttccagatgttgtccatgagttttggctgggctatcaactgctctgcttgacaattccgaatattaaattatgttttcactgccacttttagtattctgtttgctattgttaaagttgaaaacgaattttgggcaggtgtattagcttgctagggttgctgtaacaaagtactacaaattggatagtttacaatggcagagatgtattctctcacagctctggaggccagaagttccagatcaaaacgtgacaggcccatgcttccccagaaggccctaggggagaatccatccttgcctcttcagcttctggtgcgcttctagctgtcctgggcttggcatgttgctcttaatcactccaatctctgcctccgtcttatgtcacctgcccccttttctccctgtatcttctcttctgtctcttataagggcacttgtcattgggtttagggtctgggtacctggataatccagatgcttttatctcaagatccttaacttaattacatctacaaagaccattttccaaagaaagtcacatccccaggttctggagattaagatgtggatatatctttttggtgctaccattatacccactacagtgggagagagtgaaatcttctgatttttaaatggcaactgatttacacttttaaaaagtctgtgcagggactgggtgcggtggtccacgcctgtaatcccagcacttcgggaggctgtggcaggtggattgcttgagctcaggagtttgagaccagcctgggcaatatggtgaaaccccatcgctaccaaaaatgtacaaaaattagttggacatgggccgggcgcggcggatcacaaggtcaggagattgagaccatcttggctaacacagtgaaaccccgtctctactacaaatacaaaaaaaaaaaaaaaaagccgggcgtggtggcgggcgcctgtagtcctagctactcgggaggctgaggcaggagaatggtgtgaacctggaaggcggagcttgcagtgagccaggatcacaccactgcactccagcctgggctacagagccagactctgtctcaaaataaaataaaataaaataaaataataaataaataaaaaaaaacaaataaataaaaattagttgggcatggtggttcgcacctgtagtcccagctacttgggaggctgaagcaagaggatcacttaagcccaggaagcagaggttgcattgagccgagattgcgccaatgcacttcaacctgggcgacagagggagatcctgtctcaaaaaataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcccctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatgggggtggggtggggagaccgacaagccagcaggttgtcccatatggaatcgttgtccagtttctaccatttagagctatgttactgaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccagggagtggtgtgcagactcagtgaggcctcctgctaatgtatacaccctgaagtggctggtgagccccgctcttggcggggactttagcgtaatagtaagacgggcaggatcgctcactgggctcctgcaagcggtaggtcaactccctggagtaaaaagtttatggtagaactcagcctcttaagtccctggagtaagatttaccataggaagctgcttatcttagtgttttccaggtctctggtcagcagagatgatatcggaggggctggggtccagatggatgggttggttggggtgcccaccacctgtggggacccactagtttgcagcagaggcccgtagggggcatgccgaggccttctcgctgcaggatgctgagctgcagatgcccttgctcagctcgaagtagggtgggtgcaggctgaggttgcctgctctaggatggccagcagcagtgctgcagggccccaggggcagcccgaacagagcctcaagcagcgctttgccatcttcctggctcctagagcctggtatttctgtaagtaagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatctcacgaatcagcactaaagaatttactcatgtaaccaaacaacacccgttccccaataacctatggaaataaaaattaaaataaataaaaatgtgaactccaggatggggtattttcgatggcttttattctgttacctcagtgggtacccagtactggaattccacgtggcttccttaatgtcccactttttctctctttgtttctctattaaaggaaaaagtacccacctccatgatattccagagacctagagatgagggaaacctgtactttttgagctcactgccccttccactattctctctataagtctccatggccaacccctgtggcattaattggtgttctctatcctgatacctctcaaagacatcctaaccccttcttccccaagcccaggcttgtatttctaactgtgtagcaaacctccctgtgtgtttagtcgatacctcaaatgtatctaagatgatgatttcttcctcatatgaacaccaccaccaaaccctcctctcccctgtgtccttttcttccctgctgtgacccagttgatggatggtctcttggaagcagaggctgtagctgtcctagagccctctggctcctgcaggattacactgagcccctccctgtacctgccgcctctcactgtttttactgtggtccatcttttggggactacagcaaattggaactcatcatccaccgcctccggtggcaggctcctcagccagcaccaggtgaaaagttgcacttcttatctcctaaaggcctttgctgctgggccctgcctacctctgtatgacagttattgaagtttctaccataggcaccaattccagttgtacaggagacttagaattcttcccagaaggggtttttgagtgacaagagctgttcggaaactgcttcgaaaagcaataaacaaaaacaaaaaccccaaatgaactgcttagggttttcgttgttgttgttgtttttgagaccgaatcttgctctgttgcccaggctggagtgcagtggcacaatcttggcttactgcaacctctgcctcccgggttcaaacagttctccacctcagccttccaagtggctggaattacaggcactcaccaccacatccagataattttgtgtttttaatagagacgtggtttcaccacgttgcccaggctggtctcgaactcctggctcaagccatccacctgcctcggcctcccaaagtgttgggattacaggcatgagccaccgcgcctggccagcttagtttttaagagttttctacctggtctccttcctctctcacttggtcaactggtacccaccccgaggtgcctgtcctgaaacctcacctctcctacccatgcatgggcttggggaaaggacctgagccaccttttattcaggttctctattccctgcccccggaccccaggcacactttcccccctctatttctggttttatccctagtagcaccttaatccttgacactgccttctagcattctctgtgttcatgctagaaccacccaagtggataaaggggaccttacttctctattgttccttccccctctcctctctgctgctggtgaaggagggaaaggaaagatgatcctctcattctggtgtagaagagtttgtggactctggggaagaacttgatttctgaggtcacttaagggctgaaggtgaaaaattaactagttttgttttattttaaattttttatagagacagggtctcactctgtcgcccaggctggagtgcagtggtgcgatcatggctcacttaggccttgacctcccgggcttaaggaatcctcctgcctcatcctcccaagtagctgggactacaggcgtgtgccaccatgcttagcttattatttttagtttttttttttttttttttaatccaagcacactgtctgtattctctgaacagaattgatcttctaatttagtatttttcaaacatttctttacctataatttgtagtaggaggtaatcataaccctggaaataacacatctgtgtaaatgcaaaacaaatacatgcataggccgggcatggtggctcacgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacagaagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgacatctctctctctctctcttttttttttaatgccccgatacaattcttaagcttaaaattatattttcctttgtagctttgccaatttgagaatttacccacatggattggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaagggatagttggtatgggagagtggaattgggccaggcgtctacaggctgctagagggtaggaggagggacaggtcaatcttgcacagctctgtcaacatggcctcagtcgttgggtctgtaatttagttcttccatgcagcttattctacaagcccattgatttttcttttaattgtagattttgaacaaagtagaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgataagaaaatttgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcagattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcatacatttatgggcttcagcattcatgagaagtctggttcttttccttttttggtataggagttttctaagagtggagttaagctttagatcttcaaaataccttgcttatgcttgtcacagtttttattatcttttcatgaaataaggttgacgacagctagaaattgggtataccttgttgtaaaccctttgttactggcctcaaaaggacaaggattgctatccttttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgtgttcccgatgtgatgcctgtgtaatatatgtcaacctgattctaaccatgaagagtgagagattatcaggtaaacccacgagtcatttttcagcagaatagctggtctgtacttggagatatcagtgtcatgaaacataccagtaaaaaaaaaattatacgttacatgaggataaaaaagaaaaaaaaaacagggaaatgcagtgtatgagcctttattcaagagcagaacatctataaaggatataactggggacacttgaagatggactctgtactagataaccatatcatacccatgtgaactggtgtaaatgtggtaatgtccatgtagttatgtagatagtcttaagagacagatgctgctggagcatttgaaatatgaagtgtgcagtggccatcttctccttcagctttttgttagagaaaatctaaagcatgacaggattttttaaaaagtgaactgtgtacaatagttgtcaacatttggtggtggccgtgattatataaaactaaaagcccaagctttggattcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagatatcctttgttgtataagagaacaagttcagtgggcttcttttgtttccttccttcagtgtctcacaactcaaattaatgttaccacagactagaggcaaatgtgttacctagactgccttgaacagacaatttagtaacagtacccttttatgtggccatcaacaaagaaataatcagctgggcacagtggctcatgcctgtaatcctagcactttgggaggccgaggcgggtggatcacctgaggtcaggagttcaagaccagcctgatcgacatggcgaaaccctacctctactaaaattacaaaaattagccaggcatggtggcgggcacctgtaatcccagctactcgggaggctgagacaggagaattgcttgaaccctaggtggcagaggttgcagtaagccaagattgcgcaacttcactccagcctgggtgacagtaagactctgtctcaaaaacaaacaaataatctacctagttgaggattaaagagcaaaggactttgatactgtgtctgctgcctagcagtttccaaaatggcttctctaaagccatctcatgaggagaaaagaagattaagttccttttgagtgtccttagtgtgaaaataaagtcactgcctcattcatcattttgttaaatttgtgatacccaagttagtattataaaacctttgtttgtcttaatcctttctttaaagtattactatttcagaattctttgatatacccaaattctccttaacctgttgcggacattgaccaaatggtgattgatgggtgtaagaaatacatgcgaaaaacgtgtggcgatgtcttagacaatcttaaaggagactgctatcaggtaattgttttctggataatgtagttttaagtgaactaataatataagttattgatcagaattgtgccttattaaaacagcttttagtatagttggttgagaagataaatacatcatctgtctcttcatatgagttatatgtatatttgtatttagggtgcacacgtaccaatgatgggaaagcaccaactccagattctctgaattaaataaaattaattctttttttttttattatactttcagttctacggtacatgtgcagaatgtacaggtttgttacataggtatacacgtgccatggtggtttgctgcacctatgaacccatcatctaggttttaagccctgcatgcgttaggtatttctcctaatgctatccttcccctagccccctacccccgatcggccccggtgtgtgatgttcccctccctgtgtccatgtgttctcattgttcagcttacacttaggagtgagaacatgcggtgtttggttttctgttcttgtgttagtttgctgagaatgatggtttccagcttcatccatgtccttgcagaggacatgaactcattcttttttatggctgcatagtattccatggcatatatgtgccacattttctttatccagcctatccttaatgggcatttgggttggttccaagtctttgctattgtgaatagtgccgcaataaatatacgtgtgcatgtgtctttatagtagaatgacttataatcctttgtatgtatacccagtaatgtgatcgctgggtcaaatggtatttctagtcctagatccttgaggaatcgctacgctgtcttctacaatggttgaactaatttacactcccaccaacagtataaaagtgttcctatttctcctcatcctctccagcatctgttgcttcctgactttttaatgatggccattctaactccagcttgggctgcagagcgagaatgtctcaaaaaaaaaaaaaaatcttaataaaaaaaaaaaccttaataataataataaaaaagaaaccttagtagtaaaaatcaagtagtacacaaagctaaagattgcttttacatatgtacaaaatttccaagtaaaataataagctaaatctggcaaattaagtctatattatgctcaagtaggatttagttagaagtgtaaagatttcaattttaagaaatctgtcaacttaattcgttaggtgaataatttaaaggaggaaaataacagatgacaaagaatttgagaatatttagcagtcattttaaataaaaactaatgcagtatagccatgtaaaattagccaggtgtggcggcgtgtgcctgtaattccagctacatggaaggctgaggcaggagaatcgcttgaacccggaaggtggaggttgcagtgagctgagattgcaccactgcactccagcctgggcaacagagggagactgtctccaaaaaaaaaaaaaaatatatatatatatatatatatatttccatctaacaaatctgtacatgtacttcctgaatctaaaataaaagttaaattataaattacttgaataaaataaaattgcaatagagatgaaactacctgaacgttaatagaaacttaggttgtggtaaatagaaaaatagaaaatataatagatagcaaaagccatttccactgaaaataggaagaagatgaggatgcctattatctttttcaacattattttttgaggtagctgagatagtaaagtagatgaaaacagtataaatctaattatttgtagatgatgtgaatactagaaaatccaggaaacttacgtaggaaattatttgaattaatgagaatttgataaagtgattggataaagccagcctagattttttctctatactaaatgctaactcatttaaataggatttccttcccacccatttcctttcaaagtaatcaagtgttaaattcctaggaatatatttaacaagaatggtattgtgagactggtatgaattatgttaagatgttattgaaagacatcaaagtctgaatatgtggagaggcatgctgtatttcttgtattgaaagaacaggccgggcttggtggctcacctgtaatcccagcactttgggaggccgaggtgggtggatcacttgaagtcaggagttggagaacagcctggtcaacatggtgaaatcctgtctctactaaaaatacaaaaattagcccgacgtggtggtgggtgcttataatccagctactctggaggctgaggcaggagaattgcttgaacccgggaggtggaggttgcagtgagccaagattgcaccactgcactccagcctgggtggcagagcaagactccgtctcaaaaaaaaaaaggaacaatgtctattcttcccaatttattatgagtaatcccaaggaggggggaggggtttaaaagtagaccaactgattttgaagttgatttgtaaaaataagtatctaagaatacccaagaaaacttgaaaaaagaatcatagtgtgaagcgaaatatgtcctatttgttgttaatgtactataaggcacgataatcaaataggaagtatgaaaggaatacacaaggacctaggaatgtcaaaggaacttgaacaggtctgagtatgtattcctacacactgctaatatggtctaagatacatttcagttgacttgggaaaagcgttagttgagttagtgtgtgatgccggtataagaagttatccatctgcatgagaaccaagttagctaacaatagaaataggaattttggtgacttaggctctaaatgtaaaaactaatacatttaagacaatttagagtacttaaccttggagttcagaaatctcttaaagataggacactcaaactgttaatggtattataatgttgtcattaccaagccaaaagtcagactagaagaaagactagtaacaagcatgacagggaattgatcccttgaataatgcagagtccctacaacttagaaatgaagttagctaaatttaaaaaggtatagaggatatttactggtacttctcagaataagtcaaataacctgtaaaaagtaccacaagacaggccgggcgcggtggctcacacctgtaatcccagcactttgggaggctgaggtgggcggatcacgaggtcaggagatcgagaccatcctggctaacatagtgaaaccccgtctccactaaaaaaatacaaaaaaaaattagctgggcgtggtggcgggcacctgtagtctcagctactcgggaggctgaggcaggagaatggcgtgaacccgggaggcagagcttgcagtgagcccagatcgcatcactgcactccagcctgggcgacagagcaagacttgtctcaaaaaaaaaaaaaaaaaaaagtaccacaagacggtcaaccctgttggtggcccaggaagttcttgtgaaaacattagcaacagacttcacaaaatttagtagaggggcaatatctcatgctggggaggttgtggggagacaggtgctcatatgcattgctggttggcgtgtgaattgctatcaaaaccggaacacacggcttctagccggtgtttgagcacacagcccacagttaaaaaggtgtcactacaaggttttattatagctgtgcttgtagtgaccaaggcttggcaatgacaacagaaagaatgtttttagtggaatggtgtattttttaaaatgtgtgttattacctggagagatgttgggtgaaatgttcaagttccaaatgatgtgtgggattcaaattttacaaaagagaacatacatttgtgtttgtgtgcaagtattcgtaagaatctgtgtgaacgtatggaaaaaatatgagcatatcaaacaggattaatacatggattgaaagcaacggtggtgttagtacctcctatatttttccatagttggacttgtatgatgcattgaggcaagttataaaacaataggacagaaaagtcccagtttcttaaaattataactgtgaggctataagaagaatgatgagaaataacatgggataggttatcttagggaattgtggtgaactttttttaattttttttgagtcaaggtcttgctctgtcactcaggctggagcacagtggtgcgcgatgatcatggctcactacagcctcaaactcccgggctcaagcgatcctcccacctcaacttcctgagtagccgggactacaggcagataccactaggcccagctgatttttcttttttttctagagacgggctttcaccatgtcgcccaggctgctctagtactcctgggctccattgttccgcccacctcaacttcccaaagtactgggattacaggtgttgggccactgaccccagcctggcaaactcttaaactcttggtttctgactattatatttaatttttcttttacttaatgtattttttttttgaattagaaaactaaaagatgacagtaactcctgtttagttcaggatgttgcttagatccagatgtgtccccagcatagagcctcagtacttcaaagatacagccaacctcaaacttcttttctgtgttaactatatatgatctgtatgggaattccagctggtctctttattgactctgatggtgggagctgttatatatagctttattagcagtagcccaagcgttagagaaaattgagaaataacatgttaatagtttgagtaaggtgcaaaagtgaatccataaacaatgaagtcattcagtgcttagtataaaagaaaaattaggctgggtacggtggctcatgcctctaatcccagcactatgagagtctgaggtgggcagattgcttgagcccaggagttcaagaccagcctgggcaacgtagtgagaccctgtctctagaaaaactttttaaaaatagtttattaattaaaaaaataaaaattaaaagaagatgatacagatagtgataggagaggcagtatagattagagatgaaagtatgaagttggctttcagatagtaataggtatacttcgtggatctatgggcaagctggataacacctcaagtttgtttctgcattggtaaaatgggatgataatagtgcctctaggattgttgttttattgaaatgagaaggcatataaagcatatatggtaagcacttaatttttgctgttaacagacatagatgaaagttttttggttcctgtagcagttgctgtggatagctgtggatataagcccatacttggcgcttttttcctccttcctttactattgttttttgtttaactacatccacatgttggctcactcatctattcctgttctttctggaaggttctaatagaagactgtatcccggtactgaagaggtacgccaaagaagggagagaatttgattatgtgattaatgatttgacagctgttccaatctccacgtctccagaagaaggtagatttttttaaccaagatatttatgatggaaatgtttctcttggcaccatgtgagggtgaaaggatcctagagattgtgtagttctctcacgtttttgaaaaagggagttaaattgaggtccatggtggaaagatgactggatttggcttcaattcctgttctgccactcaatgagtgaactaattcagtcatttgaaacaaaaatgaagtaaaatgactcattacattaatgagacagtaaatcatttgacaatttatttaaattatgtgattttcaacctgtattggtacaaactggtcacttatctaagcaacgacatagataattccctttctcaaaccagatgtttgttccaaatcacagctagttcgtgtttttttctataaactcaagttcctgctgagtttgcaggctctgaatttctctcaggattttgctgcttgcccccttatttaaagcagttttctttcacgtttcagccactgcctttgtgtcaaatctattggtattttgagagcgagcagtgctaggtggatgtgattttggcatccaaaatcaatttcattatcgttcatgaacaagctctttgaatagtgggtcttacactcgtggctctttttctttttcctcttttggtattgagtattcgaatattttacttcagatgttgtggatacatacaaacccatatttatgaaacttgttcttttaaacattcagattccacatgggagtttctcagactgattcttgacctctcaatgaaagtgttgaaacaggatgggaaatattttacacaggtaggctacttaacagttttttccctcaaaacgctctaagactttcctgttttgaaatctgaatgcacatttttgaaatgtatatctattaaggatagagcggcatcatcggattatgttctttcaaacagtaagcttctacgttgacctgttgtctgttgggaattaatgagttatcagccctggtctttcgctgtagtatgagctgctgccaccagatggagacacagactgattttcttttttcccctcccctcatcaacatacacttgatgacaaagctctggctgtactgtgaactcctgccaccagatggaagcagattgtggtgtttttctcattctctaggggattctaaacttaaactttaaagattacattaattggggttaaaaatatacatatatatctcctattgaaatccttaacaaaattttgaaaatgacagcaaagacagctaattgataatccagtctcttggtacaaaattccttgatgcataaacataagataagcacttatgtagcattgcactctggatctctgaattattctgagtttacaggaaaatcccctccgccattttttaaaaaaagtactgccagcctggacaacatagtaagactccatttctacaaaaagtttaaaaaattagctgggtatggtggtgcatgcctgtagtcctaactctggaggctgaggtgggaggattgtttgagcctgggaggttgaagctgtagtgagctgtgatcgtgccactgccctccagcctgggtgacagagtgagaccttgactcaaaaataaacacagtattagtatactgtatttaaaagtcaggaagaggccaggtgtggtggcttacgcctgtaatcctagcactttgggaggccgaggcagttggattatctgaggtcaggagttcgagaccagcctggccaacatggtgaaatcccgtctctactaaaaatacaaaaattagccaggcatggtggcagcagcctgtaatcccagctactcaggaggctgaggcaggaaattgcttgaacctgggaggcagaggttgcagtgagccgagattgcaccactgtactccagcctgggccatagagcaagactacatctcaaaaaaaaaaaaaaaaaaaaaaaaaaaagtcaggaacaggtagaggttttcactttaaccttctgaggaggtgtctgccagcagaccctatcctggacattttatggaatctgagattactaatgctgaaaacaacttagcatttctgagagacatcttgattcaggctccagcctatcctgttgttcccctcttccctctgcgtgcaagacctgcaagcacattgtgcttaatcttggactttgcgcttggcaaaattgttcagaggctttgaggacagcaaagcactatcaatgaatggagtgtctctgccccccacaacatttagaaatgatttttacagacatgctgtagatggatataactatttaaagcaggagtctgcaaacattgggccaaatctggcctcctgcttgcatgtttgtaaagttttcttggcatgcagacacgcccatttattacatagtgtctgtggctgcttttgtactgagtagttgtggtagatactgtatgatctgcacagcctaaaatattttctatcagaccctttacagagaaagtttgctgatccctgtcttataggaaaccagtgaaacctgctcaaatgaagctttcttattgtaaagaagcaagttggacttatgatggtttttttttttttttttgagatggagttgcgctcttgtttcccaggctggagtgcaatggcgcgatctcagctcaccgcaacctccacctcctgggttcaagcgattctcctgcctcagcctcctgagtagctgggattataggcatgtgccaccacgcccggctgattttttgtatttttagtagagatggagtttctctatgttggtcaggctggtctcgaactcccaacctcaggtgatacgcccccctcggcctcccaaagtgctgggattacaggcgcgagccactgcgcccagccatgatgggtactttttaagcagagcatatggaaattttttcttttcatttttttgaggtaagttcttggtctgtagcttaggctggagtgcagtggcacagtggcactcattgcagcctcaacctcccagactgaagtgatcatcctgctttgccctcccaaagtgctgggatttcaggcatccattgccatgcctggctaatttttgtagagatgaggtctcactatgttgcccaggttggccttaaactcctagattcgagtaatcctcctccatcagcctcctgaagtgttgagattactgccatgagtgaccgtgcccaggcagaattttttcttttaggtttctgcaaatacataaaaggaaatctcaagcagcttaaattaatcaaggaaaaatgtgaggctctgggatcttgaacaaaaagagactgaaaaaaatttggatccactacaaactagtcagtctgtagtacaaaaggcaggacaaaagaagacagccacactaagtccacctgttgtctactacagccgagtggctgttcttcttttgttctgaatattggcatggcaggctgcctcctatggagagctgttatcttagtatgaaaggctaatagaatacttgcttagaatactaccacagcccatttgtgaatattaatgacccaggctttgatatcttgcctttgccaatagactttttaccaaaatcaaaaggattgtatgcccagggctgtcttggtttctaagaattgtccaaaagacatatgacatgttttctgtccccatgttcattacagttggaaccacaaaacagtctcattatgtaacacctggggttcattcagtacatttggtgattgacactgtcacatggtaagatttatgtggaccggcatgtatagccctttcaagaagtagtaattaagtcaaaaagcaagtgatttgactcaggatgtgttgatgtagttgccacagtgcagtttttttttaactgccaggtgacacgcttaggaggtaacccagattcttggcatgcccacccgctttgcccaagtgtgcagcttagaactggagtcaggttggccgggtgcggtggctcacgcctgtaatcccagcactttgggaggccgaggcaggaggatcacgagatcaggagataaagatcatcctggctaacgtggtgaaaccccgtctctactaaaaatacaaaaaattagccgggcgcggtggcagacgcctgtagtcccagctactcgggaggctgaggcaggagaatggcgtgaacccaggaggcggagcttgcagtgagccgagatcacgccactgcagtccagcctgggcaagagggagactctgtctcaaaaaaaaaaaaaaaaaaaaaaaaaaaaaaggagtcaggttaagggtgggatgaaaatgttgtgttttacaaaagctaaatgttcccacccaaaactgctagctgtgagttcgtgatgtcattggttttactgtggctgcctgaaggcagccttgtcagcatcccaggaagctggggaatgcatcgtggagggacgtgggaatcaaagtgggccaatagaatttgaattggggaggaagtgttttcatggaacctaggaggcggatcctgggacttgaccttcctctcttgtctccccacagccccatttaaaaaaaactgtaagttatatttctctctcctttctgcttgccttctagaagcaacccatctttggtctcacttttttccatttctgcattttatagatggttcttacatgtatgatttcctaaatcattatactatttaattttacttgcttttgaactggataaaagttgctaaggatgtattcttctgtacctgttactgaggtgtcatgtgcctgtaatcctaactactcaggaggattgcttgagcccaggagttcgaggacagcctgggcaacatagtgaagaccccacctctaaaataaacaaaagcaaatgtcacctgtccacacctaacatggggaaaagaactttctagaactgaagctatcgaatttggatttaatcccatagtgaagcctcaaaggggtaaagaaaccaatgactaataaaatctggactttgcaggattacgggtaaaaaaagaaacagcttgctgaaacactgaaactccctccacttaagagagaaaatcattggctaaaatctgttaaaaccaatatggccaattagaatttgcatagaacaagcttgctgatgtcacagcctaagtttccaccacttgcttcatgctaaccacttccccgccctcaagtttgcacacaagacccattagtgggcataaagaaataactatacacgcctgaggattttccagatctaccctttgctttccatccacgaatcaatcacctgcacatctcagaacctaccctttaaacttttttttgttgttgttgttgagacagagatggagtctcactctgtggcccaggctagagtacagtggcttgatcactgctcactgcaacctttgcctcccgggttcaagcacctctcctgcctcagccttccgagtagctgggattacaggtgtgagccaccacacctggctaatttttgtatttttagaagagatgggatttcaccatgttggccatgctgctctcgaactcctgacctgaagtgatctgcctgcctctgcctccaaagtgttagcattatagatgtgagccgccacacctggccccttaaaccttttctaataaaaggactgcccgtaagcccaacacagggagacatatttaagctggactcctgtctccttgttagttgacttacaataaaaagcttttcttaggccaggcacggtggcttatgcctgtaatcccagcatttggggaggctaaggcgggaggattgcttgaggccaggagtttgaggctgcactgagctatgttcacagcgctgtacttcagcctgggcaacacagcaagaccctgtctctgaaaagaaattaaaataagctttgcttttcttaaaaccccagtgtcctaatattgacttcaagcacattgggcagtgagcccctttttcttcgatagtgccaggtgtgaccccaccccttgttccatcccttcttcttatccttaatgagtgcttaattctttgctattagatttttattctgcatctcccatttgtttctcttaaaaagaaaaaatgtcattccatttaaatagacaggaaagtgaaatgtatcatgttacttttttggggtaggtgtctatttgtggtgtgtgttttcttctttgaaacttcttgacaatgttgggaaagaacaaattgaaactttcctattttcttaccacagtctgtgtaaggaagtcttcccatataacctctataaagagagagtgtggtgtcaattttaagatggcaaagccatttactgtgcaccttggtggcattttcattctatagcttccccagtggtgatgtgttctaaaaacaactgggcagttttctatttgtgaatcttaaattacacgtgtggtgtttatatgctcttacggtgaacttgatgttgaaaccaaattacatgctggcgaagggcactttggccatggccatatcccactgcaggaccctagatgatgggttactaaacaggctgacactgaaggatgacgtcacgttgagtgaatgtgctaagttaaaaccaccaaggccagctctcagaatagttctaacctcttgcccgtgactagctggctggttggttttgaaagccattctcaggagttcttacatcacaggctgcctttatttgtaaataattttcatcttgcattatacttggctattttgaggcaaattaatagtaactttttttttttctgaattggagtttcgctcttgttgccccggctggagtgcagtggcgccatctcggctcactgcaacctccacctcctgggttcaagcggttcttctgcctcagcctcccgagtagctggggttacaggcgcatgccaccacgcctggctaacttttgtattttttagtagagacagggtttcaccatgttggccaggccggtctcaaactcatgacctcaggtgatccacctgcctcagcctcccaaagttctgggattacaggcctgagctagcatgcccagcgaacagtaattttcttaagaaacggaatcagccacctggattcagtagtcttgtgaataccaacttcagagattaaaaggaaataggcggtattaaataccactttcgttttctaaattcataatgaaaagcatttggggaaaattgtgctaagaggatgataaatgcttccctagacttaatccaaatctacattttaacaagatcccctatgatatcatatgtacattaaggtgtaagaagcattgctctagagttaggcaaatactgtatccattcagcagctctgctataccttggctggcatctcttgattatcttcaccttttttttccttgtggtcacaggatggctgctgcagctccaaatatcacatctaggtcatagcttagaagaaagttgaagaggccggtggctctttctttgttcagaatcaaaagcttttccagcagctaccagcagacttccagtatatctcattgactacccctagctgctggagatgctgaaaatggggtgactgggaagggagaaatgttagaataatgaagttaagagaaagtttttgataaggtgtgcaactaggggatatccctatcgtatatatcctgaataaacttttgttctcttatacacagattctaggaaaaaaatgggggtgaatatagttctgtgtcaacattttagactcttaggagaattgtagtttaaaccattgtggaaatcaggaacactatatttttgatacttcatttgtaatataatggtgaccgttattgagaaaatttcctttgaatgagttatttgtatgaatctttgcaaattgcatggttttaattcagtgagtgtcactaataagaaattggtttcactgctttctatcatttcatattctaataatttgaaatggcttggtaaatgaggtagaaggataacgagctctaatgggtctataaatagaatgcagtgtgatttgtgaaaatacagaagccttatcttgtttttaaagatgaacttttatctaaagctagaattgttctcctttattaaagaccttcagatgagtggggcccttggaaggactcaagaatcccatttgcttatctctctttgatttaggggaactgtgtcaatctgacagaagcactgtcgctctatgaagaacagctggggcgcctgtattgtcctgtggaattttcaaaggagatcgtctgtgtcccttcatacttggaattgtatcctttgaccgtgacattctgttgccagatcaaagcacccaagtaaatcatatgccaatgaaaaaatttaaatcacaataataaacaattagcttagccatagagtatataaagccctggttctccagcttaggtgcacattggaatcccctgagaagctttaaataaaatctgagattctagacttccattctcaaaagttttggggtctggcttgccacagctttccaggtgcttttaatgatcaagcactactggtctaaagcattggttctcaaaggtgttgccagacctgcagcatcgctcaagaactagttagacatggacattctcaagccccaccccaacctgctgcccaatcagaggaattctggaggtgggggcccagtgacctgttctaccagccctcccagggatttatgtgcacctgaaaagtttgagaagccctagtctaaaataaccaccctacctgtggcaggtaaaatgtctaaagacactcattctactcttacattaaaataacctgacattaatactagtttctacacttgatgctaatttgcaacagaaatcgagaactagaatgatgttggggactgcacggttaacattggtgttctctgttagttccgcttagtaaagttagtctagagaagtaaaacacagaaagaaaaaaggaaatgagcattatcattggaaatttgtgccgcaacacagctgtgggctgtagtctgcagatgacggcttccttatctgctgttgccaagtccaggttcctgtgacggcagggtttttttgctgtcaagggagcaactgctgctgacctccagtgaggcctggtcccatcaggctggggcagagcccgacggggcaaactgcctgctgagaccagatggccagcaagaggcaatgagaaccctctagatcctccatgtgaggaggggagtactccgcctgctgggtggccgtgtccctccacagcctgtacagagcttcagcatctcctaccaactgtccacctttgtttagggttcccctcagcatttttgtcaggcctgtgtttgcatgttgggagatttgagaaatcagttgataacatttgaggcaaagtcttccacctgctagttcttctctctccctccttccttccctctcctttcctcctctgaccttttttccctctcctcctccttccctctcctcctcctgccctctcttccctcccccttctctcccttgtatctcccgctaccctaactttccctccctccctcctttcccccttccttcctttccttctcatactaattccctaaaacttgtgagactttggaagcagtagtgttacctgagagaatatttgtgttcctttagccttctgttgtctactcagtacctccttcagacctcccaggtggtgaggatgtccccaggctgcagagtggccttattcaaagtccttcgttctcattcccacagtgctctaagccatgaagcttttcatccatctttcaatttgtaggccagcaaacgaattacaagtgatgtcttttcttccttgaattacctgcttttattccttgactccctgtccaggtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 4415 - DNA, 53758 bp, human
gcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaaggtgagggcgcccgccgccacctgcgtggccatccccgccgctcccgccgcctggcgggctggggcgggggtcgggcgtggcgtgcgccgcgggccgaacaatgcgggcggcccgcgcggcgccgcactctcccggactgccacgcacagcgcgctgcggggccgcgtgcaccggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcgggtaaatttccctcttgggggcgggggtttcccctcgtagggagctggggctggggaaaggtctgcggacgcgcagcgcttgcagaattctcagccgactgcgtaggagacggatcccccggaaaggaactgggggacgggaaaaggaaacgattattattattgggggtggggaggcatgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgattttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatcttgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttgcagtggaggagttaccaattgggaatcttctcatccccttagtatgtaatttactccgttttgtttgaattggtagtttcaggccttagctaccttctcaggagataaagattaaaatgctgtgttctctaatagctttaaaaagttagagcttttgattttggatttcatacccagaagattggagattatgggctttataattgcgatcaccatggttatgctaacctttcacagataaggattagttataaagttactagcatctgtttaaaaacgtcaataaagttcttagtttagtttttggagtctgcatattccaggtgttttaattcactatttcactgcagttgtaacctaagcctgctggtgtgcactgtggctccgaccaccatttcatggtatagactcagttcttttgaaaagtcagaaaacctcctcaattgaatctgcgaaccacgtatgtaaaccatgcacaaatgctctttaaaacccttacagctaggcacttttccagaccccaggaaaaacaaccctgcggccctgaggtgtggtgggcctgggtttcattaaattgacactgtcatctgtgttccggaaggagccaccgagctagctagtggtgatactggtgataaatgtgtttacgtgctaagccacagattcaaaaggagctggtaagagccagtagcatgttctagattcctgaactgacttgactctgggtagttttacacacaccttaatttttccctctccatgaaggtgctaatgatactaaaatcccacacactgtgtcgttgggtggaatgtccaataaaatgtttggaagagtatcaaatgatacataaaatacctaacactaattgcaatacttagggcagagtactttgaaattgtgccagtggataaagatgctcagttataaagaggtgtgaatttaacttacttgaagggtaacgaaagctctgctggcaagagaagaggcagaaaataatgggttgccctgtgttttgaaggttggtctactttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacaggttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactgatttcgagctcctggactcaagggatcctccagcctgagactcctgagtcactaatgttactggtgcacactgcagtacctggctgaagttttataaatggcttaacactgaatcttttaactgtataaggcagtagctaagtggcccagttgcatgtggaattttgaggaagatggtcatgggtttctcagtccaagtgtttgttcctacgtgggggtttgtctaatttggagctggaggcttgatgttgagaagagagaggaaagagcttactattaactccctttggtatgagatgcaagaatatgacaggactttttttttttttttttttttaatttgagttctgggatgcagtacagaacgtgcaggtttgttacataggtatacatgtgccatcgtggtctgctatacctatcaacctgtcatctaggttttagaccctgcatgcatttgtcctaatgctctccctccccttgccccccaccccctgacaggcccaggtgtatgatgttcccttccctgtgttcatgtgttctcattgttgggctcccacttatgagtgagaacatgtggtgtttggttttctgttcctgtgttagtttgcctagaatgatggcttccagcatcatccatgtccctgcaaaggacaggaactcattcttttttatggttgcatagtattccatggtgtatatgtgccacattttctttatccagtctatcatagatgggcatttgggttggttccaagtctttgttattgtaaatagtgcttagtaaacatacgtatgcatgtgtctttatagtagaatgatttataatcttttgggtatatacccagtaatgggattgctgggtcagatggtttttccggttctagatccttgaggaatcaccacactgtcttccacaatagttgaactaatttacattcccaccaacagtgtaaaagcattcctatttctccacacctctccagcatttgttgtttcctgactttttaataaggaccattctaactggcatgacatggtatctcattgtggttttgatttacatttctctaatgaccagtgatgatgagcttttttcccatatgtttgttggctgcataaatgtcttcttttcagaagtgtctgttcatatccttcacccactttttgatgaggttatgtttttcttataaatttagttctttgtggattctggatattagagctttgtcagatgggtagattgcaaaaatgttctcccattctgtaggttgcctgttcactctgatgatagtttctttagctgtgcagaagctctttagttgaattaaatcccatttgtcaattttggcttttgttgcagttgcttttggtgtttttttgtcatgaagtctttgcccatgcctatgtcctgaatggtattgcctaggttttcttctagggtttttatggtttggggttttacatttaagtctttaatccatcttgagttaattttttgtataaggtgtaaggaaggggtccagtttctgttttctgcatatggctagccagttttcccagcaccgtttattaaatagggaatcctttccccattgcttgtttttgtcaggtttaggggctttttttttttttaagcattttgtgactgctaaatttttagtggagttcctgtaatttatttctttgaacaaagggtctggctttgcttcagaaggctgcaggaactgttcaagtagtggtttgtgcatttgtctttttactacatctgctcattttacactatggggttagggaaatgtaaagaaagaggggatacaactgtgatactgtcacaagtagataaccactttgatgtgtggtacaaatggcttgcttattcttgttgcatatataacaatgttgtacgtaaaaacactggattttggagcccagctgttggggtttgaatcctggttccactacttactagtgtgtgtgaccttgggcaggttgttaatctatgtgccttactgtgctggctatactttggttacccttgaatagcagctgtgagaacagacatccttgccttgtttttggaccttatggggagagcagtcttttaccattttgagtattatgctaactgtaggttttttgtagataccctttatcaagttgagaaagctctcctctattcccatttttgtgtgtttatcttgaatgagtgttggattttgtcaggttcttttttgcataaattaatataaaatgtgggtttttttctttaacctattatggtggatcacgttgtttgtttgtttgtttttttttttttttgaatgttgaactagccttgtatacctggaataaatctcacttggtcatggcatatttttctatattgctgaatcctatttgctaatgattttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaattttcgtatttttttttagagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaactgggttttcttgcatacaactgagtttctgcttacacattctttaatttcttttaattcctatttcattagtttgtgtttttagaggaattgccccatttcattcttaagttgccacatttatgtgtgtagagttgtagtattcccttatcctgttggtgcttgcagagtatccacagtgatatctcctgttattcctaatattggcaatctggttttttttctttgtaagtcttgctagagtttatcttaataatcttttcaaagaaatagctctttgcttaatttttttctcctctagtttttatcaattttattgatttttttttttttttgctgttatccttctctttttgctttggacttttctctttttctaggttcttgaagtactagtgtggattaggaatttgagattttaaagtggaattcggtactcttaagtattctcattctctagtatgcagtttctgttgatactagttgataatgttcgacgtattccttaaaaagcaagagtcttagttatgttggttgttagctgttcttttttcaacacaataaattgctaacttgaatataggaaatattcctcagattattctagtttcaaatgctaagaatgttctgaagtccttggaccagattctgctcatctggcctgtttttgtgtgaccctccagctaagaatgatctttacatcttaaaagggttgtaaagcacacacaccaaagaatatgtgacagaaacctgatttagccagaatgctttaccacgtggccctttacagaaaaagcttgcccgttcctgcctttagaccatctaggtgcaatgattttgattgcccgtttcagagccatctggaaaaatttggaagtacagatttccaagcccttcacatggctgccttctcgtctggaatccatcatagtgcacggccatctctgtgtttgagtagttttgacttgtgtcctctgtctttcatctttattctccagtggcacttacttgtccagcacctcctaggtgctgagtaatctccttgggggcccagttgaatgtggtcttggctaatatactctggtaaagccacaggaagggaaggcagagggacctcctcagcgacatgtgtatcaagtacggtctaatataaatgtgatatttttttttgacatcacacaattcccaaagtccagactgttttatctttggaaatgctatttcattgttgatacacagcctggcatagatgctcagacagaacccttgaagtattgtttttttttgagacagtcttgctctgttgcccaggatgaagtgcagtggcgtgatcttggctcacggcaacccctgccttctgggttcaagggattcccttgccccagcctcccgagtagctggtattacaggcacccactaccacagcgggctaatttttatattttagcagagacggagtttcaccatgtttgtcaggctggtcttgaactcctgacctcaaatgatccgaccgccttggcctcctaaagtgctgtgactacaggcgtgagccactgcgcccggccttgaattatttttaaacacaaaaatggtatgacctgtaagggattctgcccggttaaggttagtgagaagaaagctggatgttcatgatagtgctacagtgctcagaaagcatatttcatccttcccagataataaaactggcaatcccatggtttctactttggcaaagaaatcttgtttccccttctggacggagctaaaggaaaccattgtcatttgaccagggccaacctgtgtcctctgtttcagcctgcccctctgtgatgagggggtgaatgtaggttggtggctggggccgtctccacacgtcacatgccaattttgaactaaaagtaagggctggtcactttacctggtccagatgcattcctgagtcatctcctgttccctgacctcaaacactgcaagtcccctctcaaaaccttctttttgttacttctctaacttctcctttctgttgggttgtagcatgacccccaccccctgcttttctgtgggttctgatctcttttcctaatcctctgccttggttctcttccaccgctctgggccagagttccttcctcttctcaaaaaacatggtccttaagctgacggggcccactgaagagcatcgtaggataccttacgttgtttgcatgattcctttcaggagaggtcaagtggcctggttattcagtgtctcatagccacaaactaatggataatattccttccagatgaaaggcaggctttagtatactgtcttttgtctgtgccttgttttctgagtcttgactctcatacgggttaaatcagaagggtgaggatgggtgagtttgaatcacttgacaaccagcaagatgctgccctccccagtcccagtgtctgtgggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactactttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctataacctgatggaagtttgggtcgtttctactttctggctattgcatatcatgctactgtgaacatctgtgtcagcttgggttgtgtgtcatgagcttcatttcatcatcatgcagctgttgtaaaaaggactagacatagggctataaagccaagctgttaagtaaggcatgccaaaggaccacctgcttgacctagaaattcattaagcttctaatatctgagaagtctaataggcagatccttttttaaaattaagttaaacttttaattgtaaactagaattttcatttgtgaaattgaagtcttttttgcatatcacttgatttctgtaatctggacctgctgcctgtcagtcttcgtgcttttgatggacttagcacattctgagttcagaagatgctctcagacccttaggcagtgctcagccatgggcttgggtgaaaaggagacttgagggatgccgcgctctttgtcattcttttcagaggggttatgccagtggtgttggtgacttctgaacagatacttctttaacttggtataatttatgtaaattttagtgtaccagttctgagttttgaccaatgcatacagttgtgtaaccaccactagtatcaagattagaaacatctgaacgtggttttaaagcagctacctgatttcaaattggattggaatccagtttcctttcctcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgggttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccgggtcagaagaatgagtttctccaagacgggcctgtaaatggttccctggtagaaaatgaggcaggagggtgaagcttaggccttgattcttttttttcccttcctgtcttcccttcccttcctttagtagtggtgtatttaatttggaccagtttattcattttaagttgttgttgaacaaacacacaaagtaggcagtgggctggaaatggggacattgcgttgttcagtagacaaaggacacgttttgccttgggagaggtcactgtgtttctgagcgctttggaaggctgactgatctactagttacaatatgttgttctagcctggccattgaagtgaattttcagagaacttctgccaaagaagaacatttcattggcctaatttggatgactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaagttccatactagacaggcataaaggttgaaatttggaataattacaaagcattttctggggcatgtgacaggttacccatggcttcagttagtaaagagttctaacttttttcagcccctctgttgagcattttctataactttttggtgagttgagtataactggtatggaaatggtagggggtttcttttcctttttttgtgttgggtgatttagattagtggttctcaactgtggctggacattggaatttcccagggagcttttgaaaatactcatgcctggggcccacccccacatttctacttaattggcctaatgtgtggcattggaatttttaaaaattcctcaggtgattattattacttatttttttgaaatagggtctcactgttgcccaggctgaagtgaggtggcacaatcatgggtcactgcagccttcacctcccaggctaaggtgttcctcccatctcagcctcctgggtagctgggactataggggcatgccactatgtccggctaatttttgtatttttggtagagacagattttaccacgttgcccaggctggtctcgaactcctgggctcaagcgatcctcctgccttgacctcctaaagtgttgggattacaggcatgaaacaccatgcctggcctccctgggtgaatgaaaatgcacagctaggattgtaaaccactggtctagatgtttttgaacctctgcaaagatacagtaataaaggatgatgaattcagccaaataaaataattttttatttgccaccaaacatttattgagcacctgggatcaagatgactaagtgagccacctcatgcttttgctttgttttcactttaaaagccctgatttggaaagagatactactgcggagttttcagctctagctccccttcctggagtgtcttccccaagggctgggtgacagggaggccccaaatcaggaggaaggtgaggatgaagggagatgaatggtgggcaaaatggtggtgtccccataaggccctgcagacaccttcctggcagggctagcatactcagatgcccacagggaccaggcggccgcacaaatgaatagggcttgtgggtaaatgagcttccagaaacacgttcagctttggcctgtttttactgaacttggcgggtaagcctatagtgtgggaacaagtaatacttcaaatcggatttcttgtgtagtttttccttcagtttgaaacctggccggaggactttctttagcccacacggtgcctttctgttaattgtgccagttagaaaaaggggatggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaaggagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgactttcccaaaggcacagttttgctaggaacaaatgagagcttaaggattcattgggccaccgctgctcggtgtttatagatgcttgtgctgctgtgggagtgtgacatggattctgcgctggtagtttctccctgatgtgggactttttcttggaggctctttcattttggccatctgtagggcttgaccaccctgacatccagccctacccaagtccttgcaagtttcagctgcatcctcactttggctagccagacccctgcattctgagggggaggaaaccacttctttgggggtgaacacctgttggtgacttttggaaggggttgctctagttcttagggctgtctgaagtcccgttgctttttctcttcttcctatctcaattgctgataccccaagggtctcagggctgtggcccatttatttctacctatacctgtttggggatttagggttacactctgtcatctagttttgttccagatgttgtccatgagttttggctgggctatcaactgctctgcttgacaattccgaatattaaattatgttttcactgccacttttagtattctgtttgctattgttaaagttgaaaacgaattttgggcaggtgtattagcttgctagggttgctgtaacaaagtactacaaattggatagtttacaatggcagagatgtattctctcacagctctggaggccagaagttccagatcaaaacgtgacaggcccatgcttccccagaaggccctaggggagaatccatccttgcctcttcagcttctggtgcgcttctagctgtcctgggcttggcatgttgctcttaatcactccaatctctgcctccgtcttatgtcacctgcccccttttctccctgtatcttctcttctgtctcttataagggcacttgtcattgggtttagggtctgggtacctggataatccagatgcttttatctcaagatccttaacttaattacatctacaaagaccattttccaaagaaagtcacatccccaggttctggagattaagatgtggatatatctttttggtgctaccattatacccactacagtgggagagagtgaaatcttctgatttttaaatggcaactgatttacacttttaaaaagtctgtgcagggactgggtgcggtggtccacgcctgtaatcccagcacttcgggaggctgtggcaggtggattgcttgagctcaggagtttgagaccagcctgggcaatatggtgaaaccccatcgctaccaaaaatgtacaaaaattagttggacatgggccgggcgcggcggatcacaaggtcaggagattgagaccatcttggctaacacagtgaaaccccgtctctactacaaatacaaaaaaaaaaaaaaaaagccgggcgtggtggcgggcgcctgtagtcctagctactcgggaggctgaggcaggagaatggtgtgaacctggaaggcggagcttgcagtgagccaggatcacaccactgcactccagcctgggctacagagccagactctgtctcaaaataaaataaaataaaataaaataataaataaataaaaaaaaacaaataaataaaaattagttgggcatggtggttcgcacctgtagtcccagctacttgggaggctgaagcaagaggatcacttaagcccaggaagcagaggttgcattgagccgagattgcgccaatgcacttcaacctgggcgacagagggagatcctgtctcaaaaaataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcccctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatgggggtggggtggggagaccgacaagccagcaggttgtcccatatggaatcgttgtccagtttctaccatttagagctatgttactgaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccagggagtggtgtgcagactcagtgaggcctcctgctaatgtatacaccctgaagtggctggtgagccccgctcttggcggggactttagcgtaatagtaagacgggcaggatcgctcactgggctcctgcaagcggtaggtcaactccctggagtaaaaagtttatggtagaactcagcctcttaagtccctggagtaagatttaccataggaagctgcttatcttagtgttttccaggtctctggtcagcagagatgatatcggaggggctggggtccagatggatgggttggttggggtgcccaccacctgtggggacccactagtttgcagcagaggcccgtagggggcatgccgaggccttctcgctgcaggatgctgagctgcagatgcccttgctcagctcgaagtagggtgggtgcaggctgaggttgcctgctctaggatggccagcagcagtgctgcagggccccaggggcagcccgaacagagcctcaagcagcgctttgccatcttcctggctcctagagcctggtatttctgtaagtaagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatctcacgaatcagcactaaagaatttactcatgtaaccaaacaacacccgttccccaataacctatggaaataaaaattaaaataaataaaaatgtgaactccaggatggggtattttcgatggcttttattctgttacctcagtgggtacccagtactggaattccacgtggcttccttaatgtcccactttttctctctttgtttctctattaaaggaaaaagtacccacctccatgatattccagagacctagagatgagggaaacctgtactttttgagctcactgccccttccactattctctctataagtctccatggccaacccctgtggcattaattggtgttctctatcctgatacctctcaaagacatcctaaccccttcttccccaagcccaggcttgtatttctaactgtgtagcaaacctccctgtgtgtttagtcgatacctcaaatgtatctaagatgatgatttcttcctcatatgaacaccaccaccaaaccctcctctcccctgtgtccttttcttccctgctgtgacccagttgatggatggtctcttggaagcagaggctgtagctgtcctagagccctctggctcctgcaggattacactgagcccctccctgtacctgccgcctctcactgtttttactgtggtccatcttttggggactacagcaaattggaactcatcatccaccgcctccggtggcaggctcctcagccagcaccaggtgaaaagttgcacttcttatctcctaaaggcctttgctgctgggccctgcctacctctgtatgacagttattgaagtttctaccataggcaccaattccagttgtacaggagacttagaattcttcccagaaggggtttttgagtgacaagagctgttcggaaactgcttcgaaaagcaataaacaaaaacaaaaaccccaaatgaactgcttagggttttcgttgttgttgttgtttttgagaccgaatcttgctctgttgcccaggctggagtgcagtggcacaatcttggcttactgcaacctctgcctcccgggttcaaacagttctccacctcagccttccaagtggctggaattacaggcactcaccaccacatccagataattttgtgtttttaatagagacgtggtttcaccacgttgcccaggctggtctcgaactcctggctcaagccatccacctgcctcggcctcccaaagtgttgggattacaggcatgagccaccgcgcctggccagcttagtttttaagagttttctacctggtctccttcctctctcacttggtcaactggtacccaccccgaggtgcctgtcctgaaacctcacctctcctacccatgcatgggcttggggaaaggacctgagccaccttttattcaggttctctattccctgcccccggaccccaggcacactttcccccctctatttctggttttatccctagtagcaccttaatccttgacactgccttctagcattctctgtgttcatgctagaaccacccaagtggataaaggggaccttacttctctattgttccttccccctctcctctctgctgctggtgaaggagggaaaggaaagatgatcctctcattctggtgtagaagagtttgtggactctggggaagaacttgatttctgaggtcacttaagggctgaaggtgaaaaattaactagttttgttttattttaaattttttatagagacagggtctcactctgtcgcccaggctggagtgcagtggtgcgatcatggctcacttaggccttgacctcccgggcttaaggaatcctcctgcctcatcctcccaagtagctgggactacaggcgtgtgccaccatgcttagcttattatttttagtttttttttttttttttttaatccaagcacactgtctgtattctctgaacagaattgatcttctaatttagtatttttcaaacatttctttacctataatttgtagtaggaggtaatcataaccctggaaataacacatctgtgtaaatgcaaaacaaatacatgcataggccgggcatggtggctcacgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacagaagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgacatctctctctctctctcttttttttttaatgccccgatacaattcttaagcttaaaattatattttcctttgtagctttgccaatttgagaatttacccacatggattggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaagggatagttggtatgggagagtggaattgggccaggcgtctacaggctgctagagggtaggaggagggacaggtcaatcttgcacagctctgtcaacatggcctcagtcgttgggtctgtaatttagttcttccatgcagcttattctacaagcccattgatttttcttttaattgtagattttgaacaaagtagaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgataagaaaatttgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcagattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcatacatttatgggcttcagcattcatgagaagtctggttcttttccttttttggtataggagttttctaagagtggagttaagctttagatcttcaaaataccttgcttatgcttgtcacagtttttattatcttttcatgaaataaggttgacgacagctagaaattgggtataccttgttgtaaaccctttgttactggcctcaaaaggacaaggattgctatccttttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgtgttcccgatgtgatgcctgtgtaatatatgtcaacctgattctaaccatgaagagtgagagattatcaggtaaacccacgagtcatttttcagcagaatagctggtctgtacttggagatatcagtgtcatgaaacataccagtaaaaaaaaaattatacgttacatgaggataaaaaagaaaaaaaaaacagggaaatgcagtgtatgagcctttattcaagagcagaacatctataaaggatataactggggacacttgaagatggactctgtactagataaccatatcatacccatgtgaactggtgtaaatgtggtaatgtccatgtagttatgtagatagtcttaagagacagatgctgctggagcatttgaaatatgaagtgtgcagtggccatcttctccttcagctttttgttagagaaaatctaaagcatgacaggattttttaaaaagtgaactgtgtacaatagttgtcaacatttggtggtggccgtgattatataaaactaaaagcccaagctttggattcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagatatcctttgttgtataagagaacaagttcagtgggcttcttttgtttccttccttcagtgtctcacaactcaaattaatgttaccacagactagaggcaaatgtgttacctagactgccttgaacagacaatttagtaacagtacccttttatgtggccatcaacaaagaaataatcagctgggcacagtggctcatgcctgtaatcctagcactttgggaggccgaggcgggtggatcacctgaggtcaggagttcaagaccagcctgatcgacatggcgaaaccctacctctactaaaattacaaaaattagccaggcatggtggcgggcacctgtaatcccagctactcgggaggctgagacaggagaattgcttgaaccctaggtggcagaggttgcagtaagccaagattgcgcaacttcactccagcctgggtgacagtaagactctgtctcaaaaacaaacaaataatctacctagttgaggattaaagagcaaaggactttgatactgtgtctgctgcctagcagtttccaaaatggcttctctaaagccatctcatgaggagaaaagaagattaagttccttttgagtgtccttagtgtgaaaataaagtcactgcctcattcatcattttgttaaatttgtgatacccaagttagtattataaaacctttgtttgtcttaatcctttctttaaagtattactatttcagaattctttgatatacccaaattctccttaacctgttgcggacattgaccaaatggtgattgatgggtgtaagaaatacatgcgaaaaacgtgtggcgatgtcttagacaatcttaaaggagactgctatcaggtaattgttttctggataatgtagttttaagtgaactaataatataagttattgatcagaattgtgccttattaaaacagcttttagtatagttggttgagaagataaatacatcatctgtctcttcatatgagttatatgtatatttgtatttagggtgcacacgtaccaatgatgggaaagcaccaactccagattctctgaattaaataaaattaattctttttttttttattatactttcagttctacggtacatgtgcagaatgtacaggtttgttacataggtatacacgtgccatggtggtttgctgcacctatgaacccatcatctaggttttaagccctgcatgcgttaggtatttctcctaatgctatccttcccctagccccctacccccgatcggccccggtgtgtgatgttcccctccctgtgtccatgtgttctcattgttcagcttacacttaggagtgagaacatgcggtgtttggttttctgttcttgtgttagtttgctgagaatgatggtttccagcttcatccatgtccttgcagaggacatgaactcattcttttttatggctgcatagtattccatggcatatatgtgccacattttctttatccagcctatccttaatgggcatttgggttggttccaagtctttgctattgtgaatagtgccgcaataaatatacgtgtgcatgtgtctttatagtagaatgacttataatcctttgtatgtatacccagtaatgtgatcgctgggtcaaatggtatttctagtcctagatccttgaggaatcgctacgctgtcttctacaatggttgaactaatttacactcccaccaacagtataaaagtgttcctatttctcctcatcctctccagcatctgttgcttcctgactttttaatgatggccattctaactccagcttgggctgcagagcgagaatgtctcaaaaaaaaaaaaaaatcttaataaaaaaaaaaaccttaataataataataaaaaagaaaccttagtagtaaaaatcaagtagtacacaaagctaaagattgcttttacatatgtacaaaatttccaagtaaaataataagctaaatctggcaaattaagtctatattatgctcaagtaggatttagttagaagtgtaaagatttcaattttaagaaatctgtcaacttaattcgttaggtgaataatttaaaggaggaaaataacagatgacaaagaatttgagaatatttagcagtcattttaaataaaaactaatgcagtatagccatgtaaaattagccaggtgtggcggcgtgtgcctgtaattccagctacatggaaggctgaggcaggagaatcgcttgaacccggaaggtggaggttgcagtgagctgagattgcaccactgcactccagcctgggcaacagagggagactgtctccaaaaaaaaaaaaaaatatatatatatatatatatatatttccatctaacaaatctgtacatgtacttcctgaatctaaaataaaagttaaattataaattacttgaataaaataaaattgcaatagagatgaaactacctgaacgttaatagaaacttaggttgtggtaaatagaaaaatagaaaatataatagatagcaaaagccatttccactgaaaataggaagaagatgaggatgcctattatctttttcaacattattttttgaggtagctgagatagtaaagtagatgaaaacagtataaatctaattatttgtagatgatgtgaatactagaaaatccaggaaacttacgtaggaaattatttgaattaatgagaatttgataaagtgattggataaagccagcctagattttttctctatactaaatgctaactcatttaaataggatttccttcccacccatttcctttcaaagtaatcaagtgttaaattcctaggaatatatttaacaagaatggtattgtgagactggtatgaattatgttaagatgttattgaaagacatcaaagtctgaatatgtggagaggcatgctgtatttcttgtattgaaagaacaggccgggcttggtggctcacctgtaatcccagcactttgggaggccgaggtgggtggatcacttgaagtcaggagttggagaacagcctggtcaacatggtgaaatcctgtctctactaaaaatacaaaaattagcccgacgtggtggtgggtgcttataatccagctactctggaggctgaggcaggagaattgcttgaacccgggaggtggaggttgcagtgagccaagattgcaccactgcactccagcctgggtggcagagcaagactccgtctcaaaaaaaaaaaggaacaatgtctattcttcccaatttattatgagtaatcccaaggaggggggaggggtttaaaagtagaccaactgattttgaagttgatttgtaaaaataagtatctaagaatacccaagaaaacttgaaaaaagaatcatagtgtgaagcgaaatatgtcctatttgttgttaatgtactataaggcacgataatcaaataggaagtatgaaaggaatacacaaggacctaggaatgtcaaaggaacttgaacaggtctgagtatgtattcctacacactgctaatatggtctaagatacatttcagttgacttgggaaaagcgttagttgagttagtgtgtgatgccggtataagaagttatccatctgcatgagaaccaagttagctaacaatagaaataggaattttggtgacttaggctctaaatgtaaaaactaatacatttaagacaatttagagtacttaaccttggagttcagaaatctcttaaagataggacactcaaactgttaatggtattataatgttgtcattaccaagccaaaagtcagactagaagaaagactagtaacaagcatgacagggaattgatcccttgaataatgcagagtccctacaacttagaaatgaagttagctaaatttaaaaaggtatagaggatatttactggtacttctcagaataagtcaaataacctgtaaaaagtaccacaagacaggccgggcgcggtggctcacacctgtaatcccagcactttgggaggctgaggtgggcggatcacgaggtcaggagatcgagaccatcctggctaacatagtgaaaccccgtctccactaaaaaaatacaaaaaaaaattagctgggcgtggtggcgggcacctgtagtctcagctactcgggaggctgaggcaggagaatggcgtgaacccgggaggcagagcttgcagtgagcccagatcgcatcactgcactccagcctgggcgacagagcaagacttgtctcaaaaaaaaaaaaaaaaaaaagtaccacaagacggtcaaccctgttggtggcccaggaagttcttgtgaaaacattagcaacagacttcacaaaatttagtagaggggcaatatctcatgctggggaggttgtggggagacaggtgctcatatgcattgctggttggcgtgtgaattgctatcaaaaccggaacacacggcttctagccggtgtttgagcacacagcccacagttaaaaaggtgtcactacaaggttttattatagctgtgcttgtagtgaccaaggcttggcaatgacaacagaaagaatgtttttagtggaatggtgtattttttaaaatgtgtgttattacctggagagatgttgggtgaaatgttcaagttccaaatgatgtgtgggattcaaattttacaaaagagaacatacatttgtgtttgtgtgcaagtattcgtaagaatctgtgtgaacgtatggaaaaaatatgagcatatcaaacaggattaatacatggattgaaagcaacggtggtgttagtacctcctatatttttccatagttggacttgtatgatgcattgaggcaagttataaaacaataggacagaaaagtcccagtttcttaaaattataactgtgaggctataagaagaatgatgagaaataacatgggataggttatcttagggaattgtggtgaactttttttaattttttttgagtcaaggtcttgctctgtcactcaggctggagcacagtggtgcgcgatgatcatggctcactacagcctcaaactcccgggctcaagcgatcctcccacctcaacttcctgagtagccgggactacaggcagataccactaggcccagctgatttttcttttttttctagagacgggctttcaccatgtcgcccaggctgctctagtactcctgggctccattgttccgcccacctcaacttcccaaagtactgggattacaggtgttgggccactgaccccagcctggcaaactcttaaactcttggtttctgactattatatttaatttttcttttacttaatgtattttttttttgaattagaaaactaaaagatgacagtaactcctgtttagttcaggatgttgcttagatccagatgtgtccccagcatagagcctcagtacttcaaagatacagccaacctcaaacttcttttctgtgttaactatatatgatctgtatgggaattccagctggtctctttattgactctgatggtgggagctgttatatatagctttattagcagtagcccaagcgttagagaaaattgagaaataacatgttaatagtttgagtaaggtgcaaaagtgaatccataaacaatgaagtcattcagtgcttagtataaaagaaaaattaggctgggtacggtggctcatgcctctaatcccagcactatgagagtctgaggtgggcagattgcttgagcccaggagttcaagaccagcctgggcaacgtagtgagaccctgtctctagaaaaactttttaaaaatagtttattaattaaaaaaataaaaattaaaagaagatgatacagatagtgataggagaggcagtatagattagagatgaaagtatgaagttggctttcagatagtaataggtatacttcgtggatctatgggcaagctggataacacctcaagtttgtttctgcattggtaaaatgggatgataatagtgcctctaggattgttgttttattgaaatgagaaggcatataaagcatatatggtaagcacttaatttttgctgttaacagacatagatgaaagttttttggttcctgtagcagttgctgtggatagctgtggatataagcccatacttggcgcttttttcctccttcctttactattgttttttgtttaactacatccacatgttggctcactcatctattcctgttctttctggaaggttctaatagaagactgtatcccggtactgaagaggtacgccaaagaagggagagaatttgattatgtgattaatgatttgacagctgttccaatctccacgtctccagaagaaggtagatttttttaaccaagatatttatgatggaaatgtttctcttggcaccatgtgagggtgaaaggatcctagagattgtgtagttctctcacgtttttgaaaaagggagttaaattgaggtccatggtggaaagatgactggatttggcttcaattcctgttctgccactcaatgagtgaactaattcagtcatttgaaacaaaaatgaagtaaaatgactcattacattaatgagacagtaaatcatttgacaatttatttaaattatgtgattttcaacctgtattggtacaaactggtcacttatctaagcaacgacatagataattccctttctcaaaccagatgtttgttccaaatcacagctagttcgtgtttttttctataaactcaagttcctgctgagtttgcaggctctgaatttctctcaggattttgctgcttgcccccttatttaaagcagttttctttcacgtttcagccactgcctttgtgtcaaatctattggtattttgagagcgagcagtgctaggtggatgtgattttggcatccaaaatcaatttcattatcgttcatgaacaagctctttgaatagtgggtcttacactcgtggctctttttctttttcctcttttggtattgagtattcgaatattttacttcagatgttgtggatacatacaaacccatatttatgaaacttgttcttttaaacattcagattccacatgggagtttctcagactgattcttgacctctcaatgaaagtgttgaaacaggatgggaaatattttacacaggtaggctacttaacagttttttccctcaaaacgctctaagactttcctgttttgaaatctgaatgcacatttttgaaatgtatatctattaaggatagagcggcatcatcggattatgttctttcaaacagtaagcttctacgttgacctgttgtctgttgggaattaatgagttatcagccctggtctttcgctgtagtatgagctgctgccaccagatggagacacagactgattttcttttttcccctcccctcatcaacatacacttgatgacaaagctctggctgtactgtgaactcctgccaccagatggaagcagattgtggtgtttttctcattctctaggggattctaaacttaaactttaaagattacattaattggggttaaaaatatacatatatatctcctattgaaatccttaacaaaattttgaaaatgacagcaaagacagctaattgataatccagtctcttggtacaaaattccttgatgcataaacataagataagcacttatgtagcattgcactctggatctctgaattattctgagtttacaggaaaatcccctccgccattttttaaaaaaagtactgccagcctggacaacatagtaagactccatttctacaaaaagtttaaaaaattagctgggtatggtggtgcatgcctgtagtcctaactctggaggctgaggtgggaggattgtttgagcctgggaggttgaagctgtagtgagctgtgatcgtgccactgccctccagcctgggtgacagagtgagaccttgactcaaaaataaacacagtattagtatactgtatttaaaagtcaggaagaggccaggtgtggtggcttacgcctgtaatcctagcactttgggaggccgaggcagttggattatctgaggtcaggagttcgagaccagcctggccaacatggtgaaatcccgtctctactaaaaatacaaaaattagccaggcatggtggcagcagcctgtaatcccagctactcaggaggctgaggcaggaaattgcttgaacctgggaggcagaggttgcagtgagccgagattgcaccactgtactccagcctgggccatagagcaagactacatctcaaaaaaaaaaaaaaaaaaaaaaaaaaaagtcaggaacaggtagaggttttcactttaaccttctgaggaggtgtctgccagcagaccctatcctggacattttatggaatctgagattactaatgctgaaaacaacttagcatttctgagagacatcttgattcaggctccagcctatcctgttgttcccctcttccctctgcgtgcaagacctgcaagcacattgtgcttaatcttggactttgcgcttggcaaaattgttcagaggctttgaggacagcaaagcactatcaatgaatggagtgtctctgccccccacaacatttagaaatgatttttacagacatgctgtagatggatataactatttaaagcaggagtctgcaaacattgggccaaatctggcctcctgcttgcatgtttgtaaagttttcttggcatgcagacacgcccatttattacatagtgtctgtggctgcttttgtactgagtagttgtggtagatactgtatgatctgcacagcctaaaatattttctatcagaccctttacagagaaagtttgctgatccctgtcttataggaaaccagtgaaacctgctcaaatgaagctttcttattgtaaagaagcaagttggacttatgatggtttttttttttttttttgagatggagttgcgctcttgtttcccaggctggagtgcaatggcgcgatctcagctcaccgcaacctccacctcctgggttcaagcgattctcctgcctcagcctcctgagtagctgggattataggcatgtgccaccacgcccggctgattttttgtatttttagtagagatggagtttctctatgttggtcaggctggtctcgaactcccaacctcaggtgatacgcccccctcggcctcccaaagtgctgggattacaggcgcgagccactgcgcccagccatgatgggtactttttaagcagagcatatggaaattttttcttttcatttttttgaggtaagttcttggtctgtagcttaggctggagtgcagtggcacagtggcactcattgcagcctcaacctcccagactgaagtgatcatcctgctttgccctcccaaagtgctgggatttcaggcatccattgccatgcctggctaatttttgtagagatgaggtctcactatgttgcccaggttggccttaaactcctagattcgagtaatcctcctccatcagcctcctgaagtgttgagattactgccatgagtgaccgtgcccaggcagaattttttcttttaggtttctgcaaatacataaaaggaaatctcaagcagcttaaattaatcaaggaaaaatgtgaggctctgggatcttgaacaaaaagagactgaaaaaaatttggatccactacaaactagtcagtctgtagtacaaaaggcaggacaaaagaagacagccacactaagtccacctgttgtctactacagccgagtggctgttcttcttttgttctgaatattggcatggcaggctgcctcctatggagagctgttatcttagtatgaaaggctaatagaatacttgcttagaatactaccacagcccatttgtgaatattaatgacccaggctttgatatcttgcctttgccaatagactttttaccaaaatcaaaaggattgtatgcccagggctgtcttggtttctaagaattgtccaaaagacatatgacatgttttctgtccccatgttcattacagttggaaccacaaaacagtctcattatgtaacacctggggttcattcagtacatttggtgattgacactgtcacatggtaagatttatgtggaccggcatgtatagccctttcaagaagtagtaattaagtcaaaaagcaagtgatttgactcaggatgtgttgatgtagttgccacagtgcagtttttttttaactgccaggtgacacgcttaggaggtaacccagattcttggcatgcccacccgctttgcccaagtgtgcagcttagaactggagtcaggttggccgggtgcggtggctcacgcctgtaatcccagcactttgggaggccgaggcaggaggatcacgagatcaggagataaagatcatcctggctaacgtggtgaaaccccgtctctactaaaaatacaaaaaattagccgggcgcggtggcagacgcctgtagtcccagctactcgggaggctgaggcaggagaatggcgtgaacccaggaggcggagcttgcagtgagccgagatcacgccactgcagtccagcctgggcaagagggagactctgtctcaaaaaaaaaaaaaaaaaaaaaaaaaaaaaaggagtcaggttaagggtgggatgaaaatgttgtgttttacaaaagctaaatgttcccacccaaaactgctagctgtgagttcgtgatgtcattggttttactgtggctgcctgaaggcagccttgtcagcatcccaggaagctggggaatgcatcgtggagggacgtgggaatcaaagtgggccaatagaatttgaattggggaggaagtgttttcatggaacctaggaggcggatcctgggacttgaccttcctctcttgtctccccacagccccatttaaaaaaaactgtaagttatatttctctctcctttctgcttgccttctagaagcaacccatctttggtctcacttttttccatttctgcattttatagatggttcttacatgtatgatttcctaaatcattatactatttaattttacttgcttttgaactggataaaagttgctaaggatgtattcttctgtacctgttactgaggtgtcatgtgcctgtaatcctaactactcaggaggattgcttgagcccaggagttcgaggacagcctgggcaacatagtgaagaccccacctctaaaataaacaaaagcaaatgtcacctgtccacacctaacatggggaaaagaactttctagaactgaagctatcgaatttggatttaatcccatagtgaagcctcaaaggggtaaagaaaccaatgactaataaaatctggactttgcaggattacgggtaaaaaaagaaacagcttgctgaaacactgaaactccctccacttaagagagaaaatcattggctaaaatctgttaaaaccaatatggccaattagaatttgcatagaacaagcttgctgatgtcacagcctaagtttccaccacttgcttcatgctaaccacttccccgccctcaagtttgcacacaagacccattagtgggcataaagaaataactatacacgcctgaggattttccagatctaccctttgctttccatccacgaatcaatcacctgcacatctcagaacctaccctttaaacttttttttgttgttgttgttgagacagagatggagtctcactctgtggcccaggctagagtacagtggcttgatcactgctcactgcaacctttgcctcccgggttcaagcacctctcctgcctcagccttccgagtagctgggattacaggtgtgagccaccacacctggctaatttttgtatttttagaagagatgggatttcaccatgttggccatgctgctctcgaactcctgacctgaagtgatctgcctgcctctgcctccaaagtgttagcattatagatgtgagccgccacacctggccccttaaaccttttctaataaaaggactgcccgtaagcccaacacagggagacatatttaagctggactcctgtctccttgttagttgacttacaataaaaagcttttcttaggccaggcacggtggcttatgcctgtaatcccagcatttggggaggctaaggcgggaggattgcttgaggccaggagtttgaggctgcactgagctatgttcacagcgctgtacttcagcctgggcaacacagcaagaccctgtctctgaaaagaaattaaaataagctttgcttttcttaaaaccccagtgtcctaatattgacttcaagcacattgggcagtgagcccctttttcttcgatagtgccaggtgtgaccccaccccttgttccatcccttcttcttatccttaatgagtgcttaattctttgctattagatttttattctgcatctcccatttgtttctcttaaaaagaaaaaatgtcattccatttaaatagacaggaaagtgaaatgtatcatgttacttttttggggtaggtgtctatttgtggtgtgtgttttcttctttgaaacttcttgacaatgttgggaaagaacaaattgaaactttcctattttcttaccacagtctgtgtaaggaagtcttcccatataacctctataaagagagagtgtggtgtcaattttaagatggcaaagccatttactgtgcaccttggtggcattttcattctatagcttccccagtggtgatgtgttctaaaaacaactgggcagttttctatttgtgaatcttaaattacacgtgtggtgtttatatgctcttacggtgaacttgatgttgaaaccaaattacatgctggcgaagggcactttggccatggccatatcccactgcaggaccctagatgatgggttactaaacaggctgacactgaaggatgacgtcacgttgagtgaatgtgctaagttaaaaccaccaaggccagctctcagaatagttctaacctcttgcccgtgactagctggctggttggttttgaaagccattctcaggagttcttacatcacaggctgcctttatttgtaaataattttcatcttgcattatacttggctattttgaggcaaattaatagtaactttttttttttctgaattggagtttcgctcttgttgccccggctggagtgcagtggcgccatctcggctcactgcaacctccacctcctgggttcaagcggttcttctgcctcagcctcccgagtagctggggttacaggcgcatgccaccacgcctggctaacttttgtattttttagtagagacagggtttcaccatgttggccaggccggtctcaaactcatgacctcaggtgatccacctgcctcagcctcccaaagttctgggattacaggcctgagctagcatgcccagcgaacagtaattttcttaagaaacggaatcagccacctggattcagtagtcttgtgaataccaacttcagagattaaaaggaaataggcggtattaaataccactttcgttttctaaattcataatgaaaagcatttggggaaaattgtgctaagaggatgataaatgcttccctagacttaatccaaatctacattttaacaagatcccctatgatatcatatgtacattaaggtgtaagaagcattgctctagagttaggcaaatactgtatccattcagcagctctgctataccttggctggcatctcttgattatcttcaccttttttttccttgtggtcacaggatggctgctgcagctccaaatatcacatctaggtcatagcttagaagaaagttgaagaggccggtggctctttctttgttcagaatcaaaagcttttccagcagctaccagcagacttccagtatatctcattgactacccctagctgctggagatgctgaaaatggggtgactgggaagggagaaatgttagaataatgaagttaagagaaagtttttgataaggtgtgcaactaggggatatccctatcgtatatatcctgaataaacttttgttctcttatacacagattctaggaaaaaaatgggggtgaatatagttctgtgtcaacattttagactcttaggagaattgtagtttaaaccattgtggaaatcaggaacactatatttttgatacttcatttgtaatataatggtgaccgttattgagaaaatttcctttgaatgagttatttgtatgaatctttgcaaattgcatggttttaattcagtgagtgtcactaataagaaattggtttcactgctttctatcatttcatattctaataatttgaaatggcttggtaaatgaggtagaaggataacgagctctaatgggtctataaatagaatgcagtgtgatttgtgaaaatacagaagccttatcttgtttttaaagatgaacttttatctaaagctagaattgttctcctttattaaagaccttcagatgagtggggcccttggaaggactcaagaatcccatttgcttatctctctttgatttaggggaactgtgtcaatctgacagaagcactgtcgctctatgaagaacagctggggcgcctgtattgtcctgtggaattttcaaaggagatcgtctgtgtcccttcatacttggaattgtatcctttgaccgtgacattctgttgccagatcaaagcacccaagtaaatcatatgccaatgaaaaaatttaaatcacaataataaacaattagcttagccatagagtatataaagccctggttctccagcttaggtgcacattggaatcccctgagaagctttaaataaaatctgagattctagacttccattctcaaaagttttggggtctggcttgccacagctttccaggtgcttttaatgatcaagcactactggtctaaagcattggttctcaaaggtgttgccagacctgcagcatcgctcaagaactagttagacatggacattctcaagccccaccccaacctgctgcccaatcagaggaattctggaggtgggggcccagtgacctgttctaccagccctcccagggatttatgtgcacctgaaaagtttgagaagccctagtctaaaataaccaccctacctgtggcaggtaaaatgtctaaagacactcattctactcttacattaaaataacctgacattaatactagtttctacacttgatgctaatttgcaacagaaatcgagaactagaatgatgttggggactgcacggttaacattggtgttctctgttagttccgcttagtaaagttagtctagagaagtaaaacacagaaagaaaaaaggaaatgagcattatcattggaaatttgtgccgcaacacagctgtgggctgtagtctgcagatgacggcttccttatctgctgttgccaagtccaggttcctgtgacggcagggtttttttgctgtcaagggagcaactgctgctgacctccagtgaggcctggtcccatcaggctggggcagagcccgacggggcaaactgcctgctgagaccagatggccagcaagaggcaatgagaaccctctagatcctccatgtgaggaggggagtactccgcctgctgggtggccgtgtccctccacagcctgtacagagcttcagcatctcctaccaactgtccacctttgtttagggttcccctcagcatttttgtcaggcctgtgtttgcatgttgggagatttgagaaatcagttgataacatttgaggcaaagtcttccacctgctagttcttctctctccctccttccttccctctcctttcctcctctgaccttttttccctctcctcctccttccctctcctcctcctgccctctcttccctcccccttctctcccttgtatctcccgctaccctaactttccctccctccctcctttcccccttccttcctttccttctcatactaattccctaaaacttgtgagactttggaagcagtagtgttacctgagagaatatttgtgttcctttagccttctgttgtctactcagtacctccttcagacctcccaggtggtgaggatgtccccaggctgcagagtggccttattcaaagtccttcgttctcattcccacagtgctctaagccatgaagcttttcatccatctttcaatttgtaggccagcaaacgaattacaagtgatgtcttttcttccttgaattacctgcttttattccttgactccctgtccaggtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaat

SEQ ID NO: 4416 - DNA, 37066 bp, human
ggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcgggtaaatttccctcttgggggcgggggtttcccctcgtagggagctggggctggggaaaggtctgcggacgcgcagcgcttgcagaattctcagccgactgcgtaggagacggatcccccggaaaggaactgggggacgggaaaaggaaacgattattattattgggggtggggaggcatgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgattttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatcttgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttgcagtggaggagttaccaattgggaatcttctcatccccttagtatgtaatttactccgttttgtttgaattggtagtttcaggccttagctaccttctcaggagataaagattaaaatgctgtgttctctaatagctttaaaaagttagagcttttgattttggatttcatacccagaagattggagattatgggctttataattgcgatcaccatggttatgctaacctttcacagataaggattagttataaagttactagcatctgtttaaaaacgtcaataaagttcttagtttagtttttggagtctgcatattccaggtgttttaattcactatttcactgcagttgtaacctaagcctgctggtgtgcactgtggctccgaccaccatttcatggtatagactcagttcttttgaaaagtcagaaaacctcctcaattgaatctgcgaaccacgtatgtaaaccatgcacaaatgctctttaaaacccttacagctaggcacttttccagaccccaggaaaaacaaccctgcggccctgaggtgtggtgggcctgggtttcattaaattgacactgtcatctgtgttccggaaggagccaccgagctagctagtggtgatactggtgataaatgtgtttacgtgctaagccacagattcaaaaggagctggtaagagccagtagcatgttctagattcctgaactgacttgactctgggtagttttacacacaccttaatttttccctctccatgaaggtgctaatgatactaaaatcccacacactgtgtcgttgggtggaatgtccaataaaatgtttggaagagtatcaaatgatacataaaatacctaacactaattgcaatacttagggcagagtactttgaaattgtgccagtggataaagatgctcagttataaagaggtgtgaatttaacttacttgaagggtaacgaaagctctgctggcaagagaagaggcagaaaataatgggttgccctgtgttttgaaggttggtctactttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacaggttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactgatttcgagctcctggactcaagggatcctccagcctgagactcctgagtcactaatgttactggtgcacactgcagtacctggctgaagttttataaatggcttaacactgaatcttttaactgtataaggcagtagctaagtggcccagttgcatgtggaattttgaggaagatggtcatgggtttctcagtccaagtgtttgttcctacgtgggggtttgtctaatttggagctggaggcttgatgttgagaagagagaggaaagagcttactattaactccctttggtatgagatgcaagaatatgacaggactttttttttttttttttttttaatttgagttctgggatgcagtacagaacgtgcaggtttgttacataggtatacatgtgccatcgtggtctgctatacctatcaacctgtcatctaggttttagaccctgcatgcatttgtcctaatgctctccctccccttgccccccaccccctgacaggcccaggtgtatgatgttcccttccctgtgttcatgtgttctcattgttgggctcccacttatgagtgagaacatgtggtgtttggttttctgttcctgtgttagtttgcctagaatgatggcttccagcatcatccatgtccctgcaaaggacaggaactcattcttttttatggttgcatagtattccatggtgtatatgtgccacattttctttatccagtctatcatagatgggcatttgggttggttccaagtctttgttattgtaaatagtgcttagtaaacatacgtatgcatgtgtctttatagtagaatgatttataatcttttgggtatatacccagtaatgggattgctgggtcagatggtttttccggttctagatccttgaggaatcaccacactgtcttccacaatagttgaactaatttacattcccaccaacagtgtaaaagcattcctatttctccacacctctccagcatttgttgtttcctgactttttaataaggaccattctaactggcatgacatggtatctcattgtggttttgatttacatttctctaatgaccagtgatgatgagcttttttcccatatgtttgttggctgcataaatgtcttcttttcagaagtgtctgttcatatccttcacccactttttgatgaggttatgtttttcttataaatttagttctttgtggattctggatattagagctttgtcagatgggtagattgcaaaaatgttctcccattctgtaggttgcctgttcactctgatgatagtttctttagctgtgcagaagctctttagttgaattaaatcccatttgtcaattttggcttttgttgcagttgcttttggtgtttttttgtcatgaagtctttgcccatgcctatgtcctgaatggtattgcctaggttttcttctagggtttttatggtttggggttttacatttaagtctttaatccatcttgagttaattttttgtataaggtgtaaggaaggggtccagtttctgttttctgcatatggctagccagttttcccagcaccgtttattaaatagggaatcctttccccattgcttgtttttgtcaggtttaggggctttttttttttttaagcattttgtgactgctaaatttttagtggagttcctgtaatttatttctttgaacaaagggtctggctttgcttcagaaggctgcaggaactgttcaagtagtggtttgtgcatttgtctttttactacatctgctcattttacactatggggttagggaaatgtaaagaaagaggggatacaactgtgatactgtcacaagtagataaccactttgatgtgtggtacaaatggcttgcttattcttgttgcatatataacaatgttgtacgtaaaaacactggattttggagcccagctgttggggtttgaatcctggttccactacttactagtgtgtgtgaccttgggcaggttgttaatctatgtgccttactgtgctggctatactttggttacccttgaatagcagctgtgagaacagacatccttgccttgtttttggaccttatggggagagcagtcttttaccattttgagtattatgctaactgtaggttttttgtagataccctttatcaagttgagaaagctctcctctattcccatttttgtgtgtttatcttgaatgagtgttggattttgtcaggttcttttttgcataaattaatataaaatgtgggtttttttctttaacctattatggtggatcacgttgtttgtttgtttgtttttttttttttttgaatgttgaactagccttgtatacctggaataaatctcacttggtcatggcatatttttctatattgctgaatcctatttgctaatgattttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaattttcgtatttttttttagagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaactgggttttcttgcatacaactgagtttctgcttacacattctttaatttcttttaattcctatttcattagtttgtgtttttagaggaattgccccatttcattcttaagttgccacatttatgtgtgtagagttgtagtattcccttatcctgttggtgcttgcagagtatccacagtgatatctcctgttattcctaatattggcaatctggttttttttctttgtaagtcttgctagagtttatcttaataatcttttcaaagaaatagctctttgcttaatttttttctcctctagtttttatcaattttattgatttttttttttttttgctgttatccttctctttttgctttggacttttctctttttctaggttcttgaagtactagtgtggattaggaatttgagattttaaagtggaattcggtactcttaagtattctcattctctagtatgcagtttctgttgatactagttgataatgttcgacgtattccttaaaaagcaagagtcttagttatgttggttgttagctgttcttttttcaacacaataaattgctaacttgaatataggaaatattcctcagattattctagtttcaaatgctaagaatgttctgaagtccttggaccagattctgctcatctggcctgtttttgtgtgaccctccagctaagaatgatctttacatcttaaaagggttgtaaagcacacacaccaaagaatatgtgacagaaacctgatttagccagaatgctttaccacgtggccctttacagaaaaagcttgcccgttcctgcctttagaccatctaggtgcaatgattttgattgcccgtttcagagccatctggaaaaatttggaagtacagatttccaagcccttcacatggctgccttctcgtctggaatccatcatagtgcacggccatctctgtgtttgagtagttttgacttgtgtcctctgtctttcatctttattctccagtggcacttacttgtccagcacctcctaggtgctgagtaatctccttgggggcccagttgaatgtggtcttggctaatatactctggtaaagccacaggaagggaaggcagagggacctcctcagcgacatgtgtatcaagtacggtctaatataaatgtgatatttttttttgacatcacacaattcccaaagtccagactgttttatctttggaaatgctatttcattgttgatacacagcctggcatagatgctcagacagaacccttgaagtattgtttttttttgagacagtcttgctctgttgcccaggatgaagtgcagtggcgtgatcttggctcacggcaacccctgccttctgggttcaagggattcccttgccccagcctcccgagtagctggtattacaggcacccactaccacagcgggctaatttttatattttagcagagacggagtttcaccatgtttgtcaggctggtcttgaactcctgacctcaaatgatccgaccgccttggcctcctaaagtgctgtgactacaggcgtgagccactgcgcccggccttgaattatttttaaacacaaaaatggtatgacctgtaagggattctgcccggttaaggttagtgagaagaaagctggatgttcatgatagtgctacagtgctcagaaagcatatttcatccttcccagataataaaactggcaatcccatggtttctactttggcaaagaaatcttgtttccccttctggacggagctaaaggaaaccattgtcatttgaccagggccaacctgtgtcctctgtttcagcctgcccctctgtgatgagggggtgaatgtaggttggtggctggggccgtctccacacgtcacatgccaattttgaactaaaagtaagggctggtcactttacctggtccagatgcattcctgagtcatctcctgttccctgacctcaaacactgcaagtcccctctcaaaaccttctttttgttacttctctaacttctcctttctgttgggttgtagcatgacccccaccccctgcttttctgtgggttctgatctcttttcctaatcctctgccttggttctcttccaccgctctgggccagagttccttcctcttctcaaaaaacatggtccttaagctgacggggcccactgaagagcatcgtaggataccttacgttgtttgcatgattcctttcaggagaggtcaagtggcctggttattcagtgtctcatagccacaaactaatggataatattccttccagatgaaaggcaggctttagtatactgtcttttgtctgtgccttgttttctgagtcttgactctcatacgggttaaatcagaagggtgaggatgggtgagtttgaatcacttgacaaccagcaagatgctgccctccccagtcccagtgtctgtgggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactactttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctataacctgatggaagtttgggtcgtttctactttctggctattgcatatcatgctactgtgaacatctgtgtcagcttgggttgtgtgtcatgagcttcatttcatcatcatgcagctgttgtaaaaaggactagacatagggctataaagccaagctgttaagtaaggcatgccaaaggaccacctgcttgacctagaaattcattaagcttctaatatctgagaagtctaataggcagatccttttttaaaattaagttaaacttttaattgtaaactagaattttcatttgtgaaattgaagtcttttttgcatatcacttgatttctgtaatctggacctgctgcctgtcagtcttcgtgcttttgatggacttagcacattctgagttcagaagatgctctcagacccttaggcagtgctcagccatgggcttgggtgaaaaggagacttgagggatgccgcgctctttgtcattcttttcagaggggttatgccagtggtgttggtgacttctgaacagatacttctttaacttggtataatttatgtaaattttagtgtaccagttctgagttttgaccaatgcatacagttgtgtaaccaccactagtatcaagattagaaacatctgaacgtggttttaaagcagctacctgatttcaaattggattggaatccagtttcctttcctcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgggttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccgggtcagaagaatgagtttctccaagacgggcctgtaaatggttccctggtagaaaatgaggcaggagggtgaagcttaggccttgattcttttttttcccttcctgtcttcccttcccttcctttagtagtggtgtatttaatttggaccagtttattcattttaagttgttgttgaacaaacacacaaagtaggcagtgggctggaaatggggacattgcgttgttcagtagacaaaggacacgttttgccttgggagaggtcactgtgtttctgagcgctttggaaggctgactgatctactagttacaatatgttgttctagcctggccattgaagtgaattttcagagaacttctgccaaagaagaacatttcattggcctaatttggatgactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaagttccatactagacaggcataaaggttgaaatttggaataattacaaagcattttctggggcatgtgacaggttacccatggcttcagttagtaaagagttctaacttttttcagcccctctgttgagcattttctataactttttggtgagttgagtataactggtatggaaatggtagggggtttcttttcctttttttgtgttgggtgatttagattagtggttctcaactgtggctggacattggaatttcccagggagcttttgaaaatactcatgcctggggcccacccccacatttctacttaattggcctaatgtgtggcattggaatttttaaaaattcctcaggtgattattattacttatttttttgaaatagggtctcactgttgcccaggctgaagtgaggtggcacaatcatgggtcactgcagccttcacctcccaggctaaggtgttcctcccatctcagcctcctgggtagctgggactataggggcatgccactatgtccggctaatttttgtatttttggtagagacagattttaccacgttgcccaggctggtctcgaactcctgggctcaagcgatcctcctgccttgacctcctaaagtgttgggattacaggcatgaaacaccatgcctggcctccctgggtgaatgaaaatgcacagctaggattgtaaaccactggtctagatgtttttgaacctctgcaaagatacagtaataaaggatgatgaattcagccaaataaaataattttttatttgccaccaaacatttattgagcacctgggatcaagatgactaagtgagccacctcatgcttttgctttgttttcactttaaaagccctgatttggaaagagatactactgcggagttttcagctctagctccccttcctggagtgtcttccccaagggctgggtgacagggaggccccaaatcaggaggaaggtgaggatgaagggagatgaatggtgggcaaaatggtggtgtccccataaggccctgcagacaccttcctggcagggctagcatactcagatgcccacagggaccaggcggccgcacaaatgaatagggcttgtgggtaaatgagcttccagaaacacgttcagctttggcctgtttttactgaacttggcgggtaagcctatagtgtgggaacaagtaatacttcaaatcggatttcttgtgtagtttttccttcagtttgaaacctggccggaggactttctttagcccacacggtgcctttctgttaattgtgccagttagaaaaaggggatggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaaggagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgactttcccaaaggcacagttttgctaggaacaaatgagagcttaaggattcattgggccaccgctgctcggtgtttatagatgcttgtgctgctgtgggagtgtgacatggattctgcgctggtagtttctccctgatgtgggactttttcttggaggctctttcattttggccatctgtagggcttgaccaccctgacatccagccctacccaagtccttgcaagtttcagctgcatcctcactttggctagccagacccctgcattctgagggggaggaaaccacttctttgggggtgaacacctgttggtgacttttggaaggggttgctctagttcttagggctgtctgaagtcccgttgctttttctcttcttcctatctcaattgctgataccccaagggtctcagggctgtggcccatttatttctacctatacctgtttggggatttagggttacactctgtcatctagttttgttccagatgttgtccatgagttttggctgggctatcaactgctctgcttgacaattccgaatattaaattatgttttcactgccacttttagtattctgtttgctattgttaaagttgaaaacgaattttgggcaggtgtattagcttgctagggttgctgtaacaaagtactacaaattggatagtttacaatggcagagatgtattctctcacagctctggaggccagaagttccagatcaaaacgtgacaggcccatgcttccccagaaggccctaggggagaatccatccttgcctcttcagcttctggtgcgcttctagctgtcctgggcttggcatgttgctcttaatcactccaatctctgcctccgtcttatgtcacctgcccccttttctccctgtatcttctcttctgtctcttataagggcacttgtcattgggtttagggtctgggtacctggataatccagatgcttttatctcaagatccttaacttaattacatctacaaagaccattttccaaagaaagtcacatccccaggttctggagattaagatgtggatatatctttttggtgctaccattatacccactacagtgggagagagtgaaatcttctgatttttaaatggcaactgatttacacttttaaaaagtctgtgcagggactgggtgcggtggtccacgcctgtaatcccagcacttcgggaggctgtggcaggtggattgcttgagctcaggagtttgagaccagcctgggcaatatggtgaaaccccatcgctaccaaaaatgtacaaaaattagttggacatgggccgggcgcggcggatcacaaggtcaggagattgagaccatcttggctaacacagtgaaaccccgtctctactacaaatacaaaaaaaaaaaaaaaaagccgggcgtggtggcgggcgcctgtagtcctagctactcgggaggctgaggcaggagaatggtgtgaacctggaaggcggagcttgcagtgagccaggatcacaccactgcactccagcctgggctacagagccagactctgtctcaaaataaaataaaataaaataaaataataaataaataaaaaaaaacaaataaataaaaattagttgggcatggtggttcgcacctgtagtcccagctacttgggaggctgaagcaagaggatcacttaagcccaggaagcagaggttgcattgagccgagattgcgccaatgcacttcaacctgggcgacagagggagatcctgtctcaaaaaataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcccctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatgggggtggggtggggagaccgacaagccagcaggttgtcccatatggaatcgttgtccagtttctaccatttagagctatgttactgaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccagggagtggtgtgcagactcagtgaggcctcctgctaatgtatacaccctgaagtggctggtgagccccgctcttggcggggactttagcgtaatagtaagacgggcaggatcgctcactgggctcctgcaagcggtaggtcaactccctggagtaaaaagtttatggtagaactcagcctcttaagtccctggagtaagatttaccataggaagctgcttatcttagtgttttccaggtctctggtcagcagagatgatatcggaggggctggggtccagatggatgggttggttggggtgcccaccacctgtggggacccactagtttgcagcagaggcccgtagggggcatgccgaggccttctcgctgcaggatgctgagctgcagatgcccttgctcagctcgaagtagggtgggtgcaggctgaggttgcctgctctaggatggccagcagcagtgctgcagggccccaggggcagcccgaacagagcctcaagcagcgctttgccatcttcctggctcctagagcctggtatttctgtaagtaagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatctcacgaatcagcactaaagaatttactcatgtaaccaaacaacacccgttccccaataacctatggaaataaaaattaaaataaataaaaatgtgaactccaggatggggtattttcgatggcttttattctgttacctcagtgggtacccagtactggaattccacgtggcttccttaatgtcccactttttctctctttgtttctctattaaaggaaaaagtacccacctccatgatattccagagacctagagatgagggaaacctgtactttttgagctcactgccccttccactattctctctataagtctccatggccaacccctgtggcattaattggtgttctctatcctgatacctctcaaagacatcctaaccccttcttccccaagcccaggcttgtatttctaactgtgtagcaaacctccctgtgtgtttagtcgatacctcaaatgtatctaagatgatgatttcttcctcatatgaacaccaccaccaaaccctcctctcccctgtgtccttttcttccctgctgtgacccagttgatggatggtctcttggaagcagaggctgtagctgtcctagagccctctggctcctgcaggattacactgagcccctccctgtacctgccgcctctcactgtttttactgtggtccatcttttggggactacagcaaattggaactcatcatccaccgcctccggtggcaggctcctcagccagcaccaggtgaaaagttgcacttcttatctcctaaaggcctttgctgctgggccctgcctacctctgtatgacagttattgaagtttctaccataggcaccaattccagttgtacaggagacttagaattcttcccagaaggggtttttgagtgacaagagctgttcggaaactgcttcgaaaagcaataaacaaaaacaaaaaccccaaatgaactgcttagggttttcgttgttgttgttgtttttgagaccgaatcttgctctgttgcccaggctggagtgcagtggcacaatcttggcttactgcaacctctgcctcccgggttcaaacagttctccacctcagccttccaagtggctggaattacaggcactcaccaccacatccagataattttgtgtttttaatagagacgtggtttcaccacgttgcccaggctggtctcgaactcctggctcaagccatccacctgcctcggcctcccaaagtgttgggattacaggcatgagccaccgcgcctggccagcttagtttttaagagttttctacctggtctccttcctctctcacttggtcaactggtacccaccccgaggtgcctgtcctgaaacctcacctctcctacccatgcatgggcttggggaaaggacctgagccaccttttattcaggttctctattccctgcccccggaccccaggcacactttcccccctctatttctggttttatccctagtagcaccttaatccttgacactgccttctagcattctctgtgttcatgctagaaccacccaagtggataaaggggaccttacttctctattgttccttccccctctcctctctgctgctggtgaaggagggaaaggaaagatgatcctctcattctggtgtagaagagtttgtggactctggggaagaacttgatttctgaggtcacttaagggctgaaggtgaaaaattaactagttttgttttattttaaattttttatagagacagggtctcactctgtcgcccaggctggagtgcagtggtgcgatcatggctcacttaggccttgacctcccgggcttaaggaatcctcctgcctcatcctcccaagtagctgggactacaggcgtgtgccaccatgcttagcttattatttttagtttttttttttttttttttaatccaagcacactgtctgtattctctgaacagaattgatcttctaatttagtatttttcaaacatttctttacctataatttgtagtaggaggtaatcataaccctggaaataacacatctgtgtaaatgcaaaacaaatacatgcataggccgggcatggtggctcacgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacagaagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgacatctctctctctctctcttttttttttaatgccccgatacaattcttaagcttaaaattatattttcctttgtagctttgccaatttgagaatttacccacatggattggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaagggatagttggtatgggagagtggaattgggccaggcgtctacaggctgctagagggtaggaggagggacaggtcaatcttgcacagctctgtcaacatggcctcagtcgttgggtctgtaatttagttcttccatgcagcttattctacaagcccattgatttttcttttaattgtagattttgaacaaagtagaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgataagaaaatttgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcagattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcatacatttatgggcttcagcattcatgagaagtctggttcttttccttttttggtataggagttttctaagagtggagttaagctttagatcttcaaaataccttgcttatgcttgtcacagtttttattatcttttcatgaaataaggttgacgacagctagaaattgggtataccttgttgtaaaccctttgttactggcctcaaaaggacaaggattgctatccttttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgtgttcccgatgtgatgcctgtgtaatatatgtcaacctgattctaaccatgaagagtgagagattatcaggtaaacccacgagtcatttttcagcagaatagctggtctgtacttggagatatcagtgtcatgaaacataccagtaaaaaaaaaattatacgttacatgaggataaaaaagaaaaaaaaaacagggaaatgcagtgtatgagcctttattcaagagcagaacatctataaaggatataactggggacacttgaagatggactctgtactagataaccatatcatacccatgtgaactggtgtaaatgtggtaatgtccatgtagttatgtagatagtcttaagagacagatgctgctggagcatttgaaatatgaagtgtgcagtggccatcttctccttcagctttttgttagagaaaatctaaagcatgacaggattttttaaaaagtgaactgtgtacaatagttgtcaacatttggtggtggccgtgattatataaaactaaaagcccaagctttggattcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggta

SEQ ID NO: 4417 - DNA, 37211 bp, human
ctcccgcggctgctcccccaggcatggcacagggcctcgcctcactatggcagcagcacggcacagcacgctcgacttcatgctcggcgccaaaggtgagggcgcccgccgccacctgcgtggccatccccgccgctcccgccgcctggcgggctggggcgggggtcgggcgtggcgtgcgccgcgggccgaacaatgcgggcggcccgcgcggcgccgcactctcccggactgccacgcacagcgcgctgcggggccgcgtgcaccggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcgggtaaatttccctcttgggggcgggggtttcccctcgtagggagctggggctggggaaaggtctgcggacgcgcagcgcttgcagaattctcagccgactgcgtaggagacggatcccccggaaaggaactgggggacgggaaaaggaaacgattattattattgggggtggggaggcatgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgattttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatcttgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttgcagtggaggagttaccaattgggaatcttctcatccccttagtatgtaatttactccgttttgtttgaattggtagtttcaggccttagctaccttctcaggagataaagattaaaatgctgtgttctctaatagctttaaaaagttagagcttttgattttggatttcatacccagaagattggagattatgggctttataattgcgatcaccatggttatgctaacctttcacagataaggattagttataaagttactagcatctgtttaaaaacgtcaataaagttcttagtttagtttttggagtctgcatattccaggtgttttaattcactatttcactgcagttgtaacctaagcctgctggtgtgcactgtggctccgaccaccatttcatggtatagactcagttcttttgaaaagtcagaaaacctcctcaattgaatctgcgaaccacgtatgtaaaccatgcacaaatgctctttaaaacccttacagctaggcacttttccagaccccaggaaaaacaaccctgcggccctgaggtgtggtgggcctgggtttcattaaattgacactgtcatctgtgttccggaaggagccaccgagctagctagtggtgatactggtgataaatgtgtttacgtgctaagccacagattcaaaaggagctggtaagagccagtagcatgttctagattcctgaactgacttgactctgggtagttttacacacaccttaatttttccctctccatgaaggtgctaatgatactaaaatcccacacactgtgtcgttgggtggaatgtccaataaaatgtttggaagagtatcaaatgatacataaaatacctaacactaattgcaatacttagggcagagtactttgaaattgtgccagtggataaagatgctcagttataaagaggtgtgaatttaacttacttgaagggtaacgaaagctctgctggcaagagaagaggcagaaaataatgggttgccctgtgttttgaaggttggtctactttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacaggttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactgatttcgagctcctggactcaagggatcctccagcctgagactcctgagtcactaatgttactggtgcacactgcagtacctggctgaagttttataaatggcttaacactgaatcttttaactgtataaggcagtagctaagtggcccagttgcatgtggaattttgaggaagatggtcatgggtttctcagtccaagtgtttgttcctacgtgggggtttgtctaatttggagctggaggcttgatgttgagaagagagaggaaagagcttactattaactccctttggtatgagatgcaagaatatgacaggactttttttttttttttttttttaatttgagttctgggatgcagtacagaacgtgcaggtttgttacataggtatacatgtgccatcgtggtctgctatacctatcaacctgtcatctaggttttagaccctgcatgcatttgtcctaatgctctccctccccttgccccccaccccctgacaggcccaggtgtatgatgttcccttccctgtgttcatgtgttctcattgttgggctcccacttatgagtgagaacatgtggtgtttggttttctgttcctgtgttagtttgcctagaatgatggcttccagcatcatccatgtccctgcaaaggacaggaactcattcttttttatggttgcatagtattccatggtgtatatgtgccacattttctttatccagtctatcatagatgggcatttgggttggttccaagtctttgttattgtaaatagtgcttagtaaacatacgtatgcatgtgtctttatagtagaatgatttataatcttttgggtatatacccagtaatgggattgctgggtcagatggtttttccggttctagatccttgaggaatcaccacactgtcttccacaatagttgaactaatttacattcccaccaacagtgtaaaagcattcctatttctccacacctctccagcatttgttgtttcctgactttttaataaggaccattctaactggcatgacatggtatctcattgtggttttgatttacatttctctaatgaccagtgatgatgagcttttttcccatatgtttgttggctgcataaatgtcttcttttcagaagtgtctgttcatatccttcacccactttttgatgaggttatgtttttcttataaatttagttctttgtggattctggatattagagctttgtcagatgggtagattgcaaaaatgttctcccattctgtaggttgcctgttcactctgatgatagtttctttagctgtgcagaagctctttagttgaattaaatcccatttgtcaattttggcttttgttgcagttgcttttggtgtttttttgtcatgaagtctttgcccatgcctatgtcctgaatggtattgcctaggttttcttctagggtttttatggtttggggttttacatttaagtctttaatccatcttgagttaattttttgtataaggtgtaaggaaggggtccagtttctgttttctgcatatggctagccagttttcccagcaccgtttattaaatagggaatcctttccccattgcttgtttttgtcaggtttaggggctttttttttttttaagcattttgtgactgctaaatttttagtggagttcctgtaatttatttctttgaacaaagggtctggctttgcttcagaaggctgcaggaactgttcaagtagtggtttgtgcatttgtctttttactacatctgctcattttacactatggggttagggaaatgtaaagaaagaggggatacaactgtgatactgtcacaagtagataaccactttgatgtgtggtacaaatggcttgcttattcttgttgcatatataacaatgttgtacgtaaaaacactggattttggagcccagctgttggggtttgaatcctggttccactacttactagtgtgtgtgaccttgggcaggttgttaatctatgtgccttactgtgctggctatactttggttacccttgaatagcagctgtgagaacagacatccttgccttgtttttggaccttatggggagagcagtcttttaccattttgagtattatgctaactgtaggttttttgtagataccctttatcaagttgagaaagctctcctctattcccatttttgtgtgtttatcttgaatgagtgttggattttgtcaggttcttttttgcataaattaatataaaatgtgggtttttttctttaacctattatggtggatcacgttgtttgtttgtttgtttttttttttttttgaatgttgaactagccttgtatacctggaataaatctcacttggtcatggcatatttttctatattgctgaatcctatttgctaatgattttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaattttcgtatttttttttagagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaactgggttttcttgcatacaactgagtttctgcttacacattctttaatttcttttaattcctatttcattagtttgtgtttttagaggaattgccccatttcattcttaagttgccacatttatgtgtgtagagttgtagtattcccttatcctgttggtgcttgcagagtatccacagtgatatctcctgttattcctaatattggcaatctggttttttttctttgtaagtcttgctagagtttatcttaataatcttttcaaagaaatagctctttgcttaatttttttctcctctagtttttatcaattttattgatttttttttttttttgctgttatccttctctttttgctttggacttttctctttttctaggttcttgaagtactagtgtggattaggaatttgagattttaaagtggaattcggtactcttaagtattctcattctctagtatgcagtttctgttgatactagttgataatgttcgacgtattccttaaaaagcaagagtcttagttatgttggttgttagctgttcttttttcaacacaataaattgctaacttgaatataggaaatattcctcagattattctagtttcaaatgctaagaatgttctgaagtccttggaccagattctgctcatctggcctgtttttgtgtgaccctccagctaagaatgatctttacatcttaaaagggttgtaaagcacacacaccaaagaatatgtgacagaaacctgatttagccagaatgctttaccacgtggccctttacagaaaaagcttgcccgttcctgcctttagaccatctaggtgcaatgattttgattgcccgtttcagagccatctggaaaaatttggaagtacagatttccaagcccttcacatggctgccttctcgtctggaatccatcatagtgcacggccatctctgtgtttgagtagttttgacttgtgtcctctgtctttcatctttattctccagtggcacttacttgtccagcacctcctaggtgctgagtaatctccttgggggcccagttgaatgtggtcttggctaatatactctggtaaagccacaggaagggaaggcagagggacctcctcagcgacatgtgtatcaagtacggtctaatataaatgtgatatttttttttgacatcacacaattcccaaagtccagactgttttatctttggaaatgctatttcattgttgatacacagcctggcatagatgctcagacagaacccttgaagtattgtttttttttgagacagtcttgctctgttgcccaggatgaagtgcagtggcgtgatcttggctcacggcaacccctgccttctgggttcaagggattcccttgccccagcctcccgagtagctggtattacaggcacccactaccacagcgggctaatttttatattttagcagagacggagtttcaccatgtttgtcaggctggtcttgaactcctgacctcaaatgatccgaccgccttggcctcctaaagtgctgtgactacaggcgtgagccactgcgcccggccttgaattatttttaaacacaaaaatggtatgacctgtaagggattctgcccggttaaggttagtgagaagaaagctggatgttcatgatagtgctacagtgctcagaaagcatatttcatccttcccagataataaaactggcaatcccatggtttctactttggcaaagaaatcttgtttccccttctggacggagctaaaggaaaccattgtcatttgaccagggccaacctgtgtcctctgtttcagcctgcccctctgtgatgagggggtgaatgtaggttggtggctggggccgtctccacacgtcacatgccaattttgaactaaaagtaagggctggtcactttacctggtccagatgcattcctgagtcatctcctgttccctgacctcaaacactgcaagtcccctctcaaaaccttctttttgttacttctctaacttctcctttctgttgggttgtagcatgacccccaccccctgcttttctgtgggttctgatctcttttcctaatcctctgccttggttctcttccaccgctctgggccagagttccttcctcttctcaaaaaacatggtccttaagctgacggggcccactgaagagcatcgtaggataccttacgttgtttgcatgattcctttcaggagaggtcaagtggcctggttattcagtgtctcatagccacaaactaatggataatattccttccagatgaaaggcaggctttagtatactgtcttttgtctgtgccttgttttctgagtcttgactctcatacgggttaaatcagaagggtgaggatgggtgagtttgaatcacttgacaaccagcaagatgctgccctccccagtcccagtgtctgtgggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactactttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctataacctgatggaagtttgggtcgtttctactttctggctattgcatatcatgctactgtgaacatctgtgtcagcttgggttgtgtgtcatgagcttcatttcatcatcatgcagctgttgtaaaaaggactagacatagggctataaagccaagctgttaagtaaggcatgccaaaggaccacctgcttgacctagaaattcattaagcttctaatatctgagaagtctaataggcagatccttttttaaaattaagttaaacttttaattgtaaactagaattttcatttgtgaaattgaagtcttttttgcatatcacttgatttctgtaatctggacctgctgcctgtcagtcttcgtgcttttgatggacttagcacattctgagttcagaagatgctctcagacccttaggcagtgctcagccatgggcttgggtgaaaaggagacttgagggatgccgcgctctttgtcattcttttcagaggggttatgccagtggtgttggtgacttctgaacagatacttctttaacttggtataatttatgtaaattttagtgtaccagttctgagttttgaccaatgcatacagttgtgtaaccaccactagtatcaagattagaaacatctgaacgtggttttaaagcagctacctgatttcaaattggattggaatccagtttcctttcctcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgggttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccgggtcagaagaatgagtttctccaagacgggcctgtaaatggttccctggtagaaaatgaggcaggagggtgaagcttaggccttgattcttttttttcccttcctgtcttcccttcccttcctttagtagtggtgtatttaatttggaccagtttattcattttaagttgttgttgaacaaacacacaaagtaggcagtgggctggaaatggggacattgcgttgttcagtagacaaaggacacgttttgccttgggagaggtcactgtgtttctgagcgctttggaaggctgactgatctactagttacaatatgttgttctagcctggccattgaagtgaattttcagagaacttctgccaaagaagaacatttcattggcctaatttggatgactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaagttccatactagacaggcataaaggttgaaatttggaataattacaaagcattttctggggcatgtgacaggttacccatggcttcagttagtaaagagttctaacttttttcagcccctctgttgagcattttctataactttttggtgagttgagtataactggtatggaaatggtagggggtttcttttcctttttttgtgttgggtgatttagattagtggttctcaactgtggctggacattggaatttcccagggagcttttgaaaatactcatgcctggggcccacccccacatttctacttaattggcctaatgtgtggcattggaatttttaaaaattcctcaggtgattattattacttatttttttgaaatagggtctcactgttgcccaggctgaagtgaggtggcacaatcatgggtcactgcagccttcacctcccaggctaaggtgttcctcccatctcagcctcctgggtagctgggactataggggcatgccactatgtccggctaatttttgtatttttggtagagacagattttaccacgttgcccaggctggtctcgaactcctgggctcaagcgatcctcctgccttgacctcctaaagtgttgggattacaggcatgaaacaccatgcctggcctccctgggtgaatgaaaatgcacagctaggattgtaaaccactggtctagatgtttttgaacctctgcaaagatacagtaataaaggatgatgaattcagccaaataaaataattttttatttgccaccaaacatttattgagcacctgggatcaagatgactaagtgagccacctcatgcttttgctttgttttcactttaaaagccctgatttggaaagagatactactgcggagttttcagctctagctccccttcctggagtgtcttccccaagggctgggtgacagggaggccccaaatcaggaggaaggtgaggatgaagggagatgaatggtgggcaaaatggtggtgtccccataaggccctgcagacaccttcctggcagggctagcatactcagatgcccacagggaccaggcggccgcacaaatgaatagggcttgtgggtaaatgagcttccagaaacacgttcagctttggcctgtttttactgaacttggcgggtaagcctatagtgtgggaacaagtaatacttcaaatcggatttcttgtgtagtttttccttcagtttgaaacctggccggaggactttctttagcccacacggtgcctttctgttaattgtgccagttagaaaaaggggatggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaaggagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgactttcccaaaggcacagttttgctaggaacaaatgagagcttaaggattcattgggccaccgctgctcggtgtttatagatgcttgtgctgctgtgggagtgtgacatggattctgcgctggtagtttctccctgatgtgggactttttcttggaggctctttcattttggccatctgtagggcttgaccaccctgacatccagccctacccaagtccttgcaagtttcagctgcatcctcactttggctagccagacccctgcattctgagggggaggaaaccacttctttgggggtgaacacctgttggtgacttttggaaggggttgctctagttcttagggctgtctgaagtcccgttgctttttctcttcttcctatctcaattgctgataccccaagggtctcagggctgtggcccatttatttctacctatacctgtttggggatttagggttacactctgtcatctagttttgttccagatgttgtccatgagttttggctgggctatcaactgctctgcttgacaattccgaatattaaattatgttttcactgccacttttagtattctgtttgctattgttaaagttgaaaacgaattttgggcaggtgtattagcttgctagggttgctgtaacaaagtactacaaattggatagtttacaatggcagagatgtattctctcacagctctggaggccagaagttccagatcaaaacgtgacaggcccatgcttccccagaaggccctaggggagaatccatccttgcctcttcagcttctggtgcgcttctagctgtcctgggcttggcatgttgctcttaatcactccaatctctgcctccgtcttatgtcacctgcccccttttctccctgtatcttctcttctgtctcttataagggcacttgtcattgggtttagggtctgggtacctggataatccagatgcttttatctcaagatccttaacttaattacatctacaaagaccattttccaaagaaagtcacatccccaggttctggagattaagatgtggatatatctttttggtgctaccattatacccactacagtgggagagagtgaaatcttctgatttttaaatggcaactgatttacacttttaaaaagtctgtgcagggactgggtgcggtggtccacgcctgtaatcccagcacttcgggaggctgtggcaggtggattgcttgagctcaggagtttgagaccagcctgggcaatatggtgaaaccccatcgctaccaaaaatgtacaaaaattagttggacatgggccgggcgcggcggatcacaaggtcaggagattgagaccatcttggctaacacagtgaaaccccgtctctactacaaatacaaaaaaaaaaaaaaaaagccgggcgtggtggcgggcgcctgtagtcctagctactcgggaggctgaggcaggagaatggtgtgaacctggaaggcggagcttgcagtgagccaggatcacaccactgcactccagcctgggctacagagccagactctgtctcaaaataaaataaaataaaataaaataataaataaataaaaaaaaacaaataaataaaaattagttgggcatggtggttcgcacctgtagtcccagctacttgggaggctgaagcaagaggatcacttaagcccaggaagcagaggttgcattgagccgagattgcgccaatgcacttcaacctgggcgacagagggagatcctgtctcaaaaaataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcccctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatgggggtggggtggggagaccgacaagccagcaggttgtcccatatggaatcgttgtccagtttctaccatttagagctatgttactgaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccagggagtggtgtgcagactcagtgaggcctcctgctaatgtatacaccctgaagtggctggtgagccccgctcttggcggggactttagcgtaatagtaagacgggcaggatcgctcactgggctcctgcaagcggtaggtcaactccctggagtaaaaagtttatggtagaactcagcctcttaagtccctggagtaagatttaccataggaagctgcttatcttagtgttttccaggtctctggtcagcagagatgatatcggaggggctggggtccagatggatgggttggttggggtgcccaccacctgtggggacccactagtttgcagcagaggcccgtagggggcatgccgaggccttctcgctgcaggatgctgagctgcagatgcccttgctcagctcgaagtagggtgggtgcaggctgaggttgcctgctctaggatggccagcagcagtgctgcagggccccaggggcagcccgaacagagcctcaagcagcgctttgccatcttcctggctcctagagcctggtatttctgtaagtaagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatctcacgaatcagcactaaagaatttactcatgtaaccaaacaacacccgttccccaataacctatggaaataaaaattaaaataaataaaaatgtgaactccaggatggggtattttcgatggcttttattctgttacctcagtgggtacccagtactggaattccacgtggcttccttaatgtcccactttttctctctttgtttctctattaaaggaaaaagtacccacctccatgatattccagagacctagagatgagggaaacctgtactttttgagctcactgccccttccactattctctctataagtctccatggccaacccctgtggcattaattggtgttctctatcctgatacctctcaaagacatcctaaccccttcttccccaagcccaggcttgtatttctaactgtgtagcaaacctccctgtgtgtttagtcgatacctcaaatgtatctaagatgatgatttcttcctcatatgaacaccaccaccaaaccctcctctcccctgtgtccttttcttccctgctgtgacccagttgatggatggtctcttggaagcagaggctgtagctgtcctagagccctctggctcctgcaggattacactgagcccctccctgtacctgccgcctctcactgtttttactgtggtccatcttttggggactacagcaaattggaactcatcatccaccgcctccggtggcaggctcctcagccagcaccaggtgaaaagttgcacttcttatctcctaaaggcctttgctgctgggccctgcctacctctgtatgacagttattgaagtttctaccataggcaccaattccagttgtacaggagacttagaattcttcccagaaggggtttttgagtgacaagagctgttcggaaactgcttcgaaaagcaataaacaaaaacaaaaaccccaaatgaactgcttagggttttcgttgttgttgttgtttttgagaccgaatcttgctctgttgcccaggctggagtgcagtggcacaatcttggcttactgcaacctctgcctcccgggttcaaacagttctccacctcagccttccaagtggctggaattacaggcactcaccaccacatccagataattttgtgtttttaatagagacgtggtttcaccacgttgcccaggctggtctcgaactcctggctcaagccatccacctgcctcggcctcccaaagtgttgggattacaggcatgagccaccgcgcctggccagcttagtttttaagagttttctacctggtctccttcctctctcacttggtcaactggtacccaccccgaggtgcctgtcctgaaacctcacctctcctacccatgcatgggcttggggaaaggacctgagccaccttttattcaggttctctattccctgcccccggaccccaggcacactttcccccctctatttctggttttatccctagtagcaccttaatccttgacactgccttctagcattctctgtgttcatgctagaaccacccaagtggataaaggggaccttacttctctattgttccttccccctctcctctctgctgctggtgaaggagggaaaggaaagatgatcctctcattctggtgtagaagagtttgtggactctggggaagaacttgatttctgaggtcacttaagggctgaaggtgaaaaattaactagttttgttttattttaaattttttatagagacagggtctcactctgtcgcccaggctggagtgcagtggtgcgatcatggctcacttaggccttgacctcccgggcttaaggaatcctcctgcctcatcctcccaagtagctgggactacaggcgtgtgccaccatgcttagcttattatttttagtttttttttttttttttttaatccaagcacactgtctgtattctctgaacagaattgatcttctaatttagtatttttcaaacatttctttacctataatttgtagtaggaggtaatcataaccctggaaataacacatctgtgtaaatgcaaaacaaatacatgcataggccgggcatggtggctcacgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacagaagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgacatctctctctctctctcttttttttttaatgccccgatacaattcttaagcttaaaattatattttcctttgtagctttgccaatttgagaatttacccacatggattggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaagggatagttggtatgggagagtggaattgggccaggcgtctacaggctgctagagggtaggaggagggacaggtcaatcttgcacagctctgtcaacatggcctcagtcgttgggtctgtaatttagttcttccatgcagcttattctacaagcccattgatttttcttttaattgtagattttgaacaaagtagaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgataagaaaatttgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcagattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcatacatttatgggcttcagcattcatgagaagtctggttcttttccttttttggtataggagttttctaagagtggagttaagctttagatcttcaaaataccttgcttatgcttgtcacagtttttattatcttttcatgaaataaggttgacgacagctagaaattgggtataccttgttgtaaaccctttgttactggcctcaaaaggacaaggattgctatccttttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgtgttcccgatgtgatgcctgtgtaatatatgtcaacctgattctaaccatgaagagtgagagattatcaggtaaacccacgagtcatttttcagcagaatagctggtctgtacttggagatatcagtgtcatgaaacataccagtaaaaaaaaaattatacgttacatgaggataaaaaagaaaaaaaaaacagggaaatgcagtgtatgagcctttattcaagagcagaacatctataaaggatataactggggacacttgaagatggactctgtactagataaccatatcatacccatgtgaactggtgtaaatgtggtaatgtccatgtagttatgtagatagtcttaagagacagatgctgctggagcatttgaaatatgaagtgtgcagtggccatcttctccttcagctttttgttagagaaaatctaaagcatgacaggattttttaaaaagtgaactgtgtacaatagttgtcaacatttggtggtggccgtgattatataaaactaaaagcccaagctttggattcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagagtgatttggcatataccc

SEQ ID NO: 4418 - DNA, 66945 bp, human
ctcccagccggccgcagcctgacacgccgcgcggccccccagtctcccgcggctgctcccccaggcatggcacagggcctcgcctcactatggcagcagcacggcacagcacgctcgacttcatgctcggcgccaaaggtgagggcgcccgccgccacctgcgtggccatccccgccgctcccgccgcctggcgggctggggcgggggtcgggcgtggcgtgcgccgcgggccgaacaatgcgggcggcccgcgcggcgccgcactctcccggactgccacgcacagcgcgctgcggggccgcgtgcaccggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcgggtaaatttccctcttgggggcgggggtttcccctcgtagggagctggggctggggaaaggtctgcggacgcgcagcgcttgcagaattctcagccgactgcgtaggagacggatcccccggaaaggaactgggggacgggaaaaggaaacgattattattattgggggtggggaggcatgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgattttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatcttgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttgcagtggaggagttaccaattgggaatcttctcatccccttagtatgtaatttactccgttttgtttgaattggtagtttcaggccttagctaccttctcaggagataaagattaaaatgctgtgttctctaatagctttaaaaagttagagcttttgattttggatttcatacccagaagattggagattatgggctttataattgcgatcaccatggttatgctaacctttcacagataaggattagttataaagttactagcatctgtttaaaaacgtcaataaagttcttagtttagtttttggagtctgcatattccaggtgttttaattcactatttcactgcagttgtaacctaagcctgctggtgtgcactgtggctccgaccaccatttcatggtatagactcagttcttttgaaaagtcagaaaacctcctcaattgaatctgcgaaccacgtatgtaaaccatgcacaaatgctctttaaaacccttacagctaggcacttttccagaccccaggaaaaacaaccctgcggccctgaggtgtggtgggcctgggtttcattaaattgacactgtcatctgtgttccggaaggagccaccgagctagctagtggtgatactggtgataaatgtgtttacgtgctaagccacagattcaaaaggagctggtaagagccagtagcatgttctagattcctgaactgacttgactctgggtagttttacacacaccttaatttttccctctccatgaaggtgctaatgatactaaaatcccacacactgtgtcgttgggtggaatgtccaataaaatgtttggaagagtatcaaatgatacataaaatacctaacactaattgcaatacttagggcagagtactttgaaattgtgccagtggataaagatgctcagttataaagaggtgtgaatttaacttacttgaagggtaacgaaagctctgctggcaagagaagaggcagaaaataatgggttgccctgtgttttgaaggttggtctactttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacaggttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactgatttcgagctcctggactcaagggatcctccagcctgagactcctgagtcactaatgttactggtgcacactgcagtacctggctgaagttttataaatggcttaacactgaatcttttaactgtataaggcagtagctaagtggcccagttgcatgtggaattttgaggaagatggtcatgggtttctcagtccaagtgtttgttcctacgtgggggtttgtctaatttggagctggaggcttgatgttgagaagagagaggaaagagcttactattaactccctttggtatgagatgcaagaatatgacaggactttttttttttttttttttttaatttgagttctgggatgcagtacagaacgtgcaggtttgttacataggtatacatgtgccatcgtggtctgctatacctatcaacctgtcatctaggttttagaccctgcatgcatttgtcctaatgctctccctccccttgccccccaccccctgacaggcccaggtgtatgatgttcccttccctgtgttcatgtgttctcattgttgggctcccacttatgagtgagaacatgtggtgtttggttttctgttcctgtgttagtttgcctagaatgatggcttccagcatcatccatgtccctgcaaaggacaggaactcattcttttttatggttgcatagtattccatggtgtatatgtgccacattttctttatccagtctatcatagatgggcatttgggttggttccaagtctttgttattgtaaatagtgcttagtaaacatacgtatgcatgtgtctttatagtagaatgatttataatcttttgggtatatacccagtaatgggattgctgggtcagatggtttttccggttctagatccttgaggaatcaccacactgtcttccacaatagttgaactaatttacattcccaccaacagtgtaaaagcattcctatttctccacacctctccagcatttgttgtttcctgactttttaataaggaccattctaactggcatgacatggtatctcattgtggttttgatttacatttctctaatgaccagtgatgatgagcttttttcccatatgtttgttggctgcataaatgtcttcttttcagaagtgtctgttcatatccttcacccactttttgatgaggttatgtttttcttataaatttagttctttgtggattctggatattagagctttgtcagatgggtagattgcaaaaatgttctcccattctgtaggttgcctgttcactctgatgatagtttctttagctgtgcagaagctctttagttgaattaaatcccatttgtcaattttggcttttgttgcagttgcttttggtgtttttttgtcatgaagtctttgcccatgcctatgtcctgaatggtattgcctaggttttcttctagggtttttatggtttggggttttacatttaagtctttaatccatcttgagttaattttttgtataaggtgtaaggaaggggtccagtttctgttttctgcatatggctagccagttttcccagcaccgtttattaaatagggaatcctttccccattgcttgtttttgtcaggtttaggggctttttttttttttaagcattttgtgactgctaaatttttagtggagttcctgtaatttatttctttgaacaaagggtctggctttgcttcagaaggctgcaggaactgttcaagtagtggtttgtgcatttgtctttttactacatctgctcattttacactatggggttagggaaatgtaaagaaagaggggatacaactgtgatactgtcacaagtagataaccactttgatgtgtggtacaaatggcttgcttattcttgttgcatatataacaatgttgtacgtaaaaacactggattttggagcccagctgttggggtttgaatcctggttccactacttactagtgtgtgtgaccttgggcaggttgttaatctatgtgccttactgtgctggctatactttggttacccttgaatagcagctgtgagaacagacatccttgccttgtttttggaccttatggggagagcagtcttttaccattttgagtattatgctaactgtaggttttttgtagataccctttatcaagttgagaaagctctcctctattcccatttttgtgtgtttatcttgaatgagtgttggattttgtcaggttcttttttgcataaattaatataaaatgtgggtttttttctttaacctattatggtggatcacgttgtttgtttgtttgtttttttttttttttgaatgttgaactagccttgtatacctggaataaatctcacttggtcatggcatatttttctatattgctgaatcctatttgctaatgattttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaattttcgtatttttttttagagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaactgggttttcttgcatacaactgagtttctgcttacacattctttaatttcttttaattcctatttcattagtttgtgtttttagaggaattgccccatttcattcttaagttgccacatttatgtgtgtagagttgtagtattcccttatcctgttggtgcttgcagagtatccacagtgatatctcctgttattcctaatattggcaatctggttttttttctttgtaagtcttgctagagtttatcttaataatcttttcaaagaaatagctctttgcttaatttttttctcctctagtttttatcaattttattgatttttttttttttttgctgttatccttctctttttgctttggacttttctctttttctaggttcttgaagtactagtgtggattaggaatttgagattttaaagtggaattcggtactcttaagtattctcattctctagtatgcagtttctgttgatactagttgataatgttcgacgtattccttaaaaagcaagagtcttagttatgttggttgttagctgttcttttttcaacacaataaattgctaacttgaatataggaaatattcctcagattattctagtttcaaatgctaagaatgttctgaagtccttggaccagattctgctcatctggcctgtttttgtgtgaccctccagctaagaatgatctttacatcttaaaagggttgtaaagcacacacaccaaagaatatgtgacagaaacctgatttagccagaatgctttaccacgtggccctttacagaaaaagcttgcccgttcctgcctttagaccatctaggtgcaatgattttgattgcccgtttcagagccatctggaaaaatttggaagtacagatttccaagcccttcacatggctgccttctcgtctggaatccatcatagtgcacggccatctctgtgtttgagtagttttgacttgtgtcctctgtctttcatctttattctccagtggcacttacttgtccagcacctcctaggtgctgagtaatctccttgggggcccagttgaatgtggtcttggctaatatactctggtaaagccacaggaagggaaggcagagggacctcctcagcgacatgtgtatcaagtacggtctaatataaatgtgatatttttttttgacatcacacaattcccaaagtccagactgttttatctttggaaatgctatttcattgttgatacacagcctggcatagatgctcagacagaacccttgaagtattgtttttttttgagacagtcttgctctgttgcccaggatgaagtgcagtggcgtgatcttggctcacggcaacccctgccttctgggttcaagggattcccttgccccagcctcccgagtagctggtattacaggcacccactaccacagcgggctaatttttatattttagcagagacggagtttcaccatgtttgtcaggctggtcttgaactcctgacctcaaatgatccgaccgccttggcctcctaaagtgctgtgactacaggcgtgagccactgcgcccggccttgaattatttttaaacacaaaaatggtatgacctgtaagggattctgcccggttaaggttagtgagaagaaagctggatgttcatgatagtgctacagtgctcagaaagcatatttcatccttcccagataataaaactggcaatcccatggtttctactttggcaaagaaatcttgtttccccttctggacggagctaaaggaaaccattgtcatttgaccagggccaacctgtgtcctctgtttcagcctgcccctctgtgatgagggggtgaatgtaggttggtggctggggccgtctccacacgtcacatgccaattttgaactaaaagtaagggctggtcactttacctggtccagatgcattcctgagtcatctcctgttccctgacctcaaacactgcaagtcccctctcaaaaccttctttttgttacttctctaacttctcctttctgttgggttgtagcatgacccccaccccctgcttttctgtgggttctgatctcttttcctaatcctctgccttggttctcttccaccgctctgggccagagttccttcctcttctcaaaaaacatggtccttaagctgacggggcccactgaagagcatcgtaggataccttacgttgtttgcatgattcctttcaggagaggtcaagtggcctggttattcagtgtctcatagccacaaactaatggataatattccttccagatgaaaggcaggctttagtatactgtcttttgtctgtgccttgttttctgagtcttgactctcatacgggttaaatcagaagggtgaggatgggtgagtttgaatcacttgacaaccagcaagatgctgccctccccagtcccagtgtctgtgggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactactttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctataacctgatggaagtttgggtcgtttctactttctggctattgcatatcatgctactgtgaacatctgtgtcagcttgggttgtgtgtcatgagcttcatttcatcatcatgcagctgttgtaaaaaggactagacatagggctataaagccaagctgttaagtaaggcatgccaaaggaccacctgcttgacctagaaattcattaagcttctaatatctgagaagtctaataggcagatccttttttaaaattaagttaaacttttaattgtaaactagaattttcatttgtgaaattgaagtcttttttgcatatcacttgatttctgtaatctggacctgctgcctgtcagtcttcgtgcttttgatggacttagcacattctgagttcagaagatgctctcagacccttaggcagtgctcagccatgggcttgggtgaaaaggagacttgagggatgccgcgctctttgtcattcttttcagaggggttatgccagtggtgttggtgacttctgaacagatacttctttaacttggtataatttatgtaaattttagtgtaccagttctgagttttgaccaatgcatacagttgtgtaaccaccactagtatcaagattagaaacatctgaacgtggttttaaagcagctacctgatttcaaattggattggaatccagtttcctttcctcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgggttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccgggtcagaagaatgagtttctccaagacgggcctgtaaatggttccctggtagaaaatgaggcaggagggtgaagcttaggccttgattcttttttttcccttcctgtcttcccttcccttcctttagtagtggtgtatttaatttggaccagtttattcattttaagttgttgttgaacaaacacacaaagtaggcagtgggctggaaatggggacattgcgttgttcagtagacaaaggacacgttttgccttgggagaggtcactgtgtttctgagcgctttggaaggctgactgatctactagttacaatatgttgttctagcctggccattgaagtgaattttcagagaacttctgccaaagaagaacatttcattggcctaatttggatgactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaagttccatactagacaggcataaaggttgaaatttggaataattacaaagcattttctggggcatgtgacaggttacccatggcttcagttagtaaagagttctaacttttttcagcccctctgttgagcattttctataactttttggtgagttgagtataactggtatggaaatggtagggggtttcttttcctttttttgtgttgggtgatttagattagtggttctcaactgtggctggacattggaatttcccagggagcttttgaaaatactcatgcctggggcccacccccacatttctacttaattggcctaatgtgtggcattggaatttttaaaaattcctcaggtgattattattacttatttttttgaaatagggtctcactgttgcccaggctgaagtgaggtggcacaatcatgggtcactgcagccttcacctcccaggctaaggtgttcctcccatctcagcctcctgggtagctgggactataggggcatgccactatgtccggctaatttttgtatttttggtagagacagattttaccacgttgcccaggctggtctcgaactcctgggctcaagcgatcctcctgccttgacctcctaaagtgttgggattacaggcatgaaacaccatgcctggcctccctgggtgaatgaaaatgcacagctaggattgtaaaccactggtctagatgtttttgaacctctgcaaagatacagtaataaaggatgatgaattcagccaaataaaataattttttatttgccaccaaacatttattgagcacctgggatcaagatgactaagtgagccacctcatgcttttgctttgttttcactttaaaagccctgatttggaaagagatactactgcggagttttcagctctagctccccttcctggagtgtcttccccaagggctgggtgacagggaggccccaaatcaggaggaaggtgaggatgaagggagatgaatggtgggcaaaatggtggtgtccccataaggccctgcagacaccttcctggcagggctagcatactcagatgcccacagggaccaggcggccgcacaaatgaatagggcttgtgggtaaatgagcttccagaaacacgttcagctttggcctgtttttactgaacttggcgggtaagcctatagtgtgggaacaagtaatacttcaaatcggatttcttgtgtagtttttccttcagtttgaaacctggccggaggactttctttagcccacacggtgcctttctgttaattgtgccagttagaaaaaggggatggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaaggagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgactttcccaaaggcacagttttgctaggaacaaatgagagcttaaggattcattgggccaccgctgctcggtgtttatagatgcttgtgctgctgtgggagtgtgacatggattctgcgctggtagtttctccctgatgtgggactttttcttggaggctctttcattttggccatctgtagggcttgaccaccctgacatccagccctacccaagtccttgcaagtttcagctgcatcctcactttggctagccagacccctgcattctgagggggaggaaaccacttctttgggggtgaacacctgttggtgacttttggaaggggttgctctagttcttagggctgtctgaagtcccgttgctttttctcttcttcctatctcaattgctgataccccaagggtctcagggctgtggcccatttatttctacctatacctgtttggggatttagggttacactctgtcatctagttttgttccagatgttgtccatgagttttggctgggctatcaactgctctgcttgacaattccgaatattaaattatgttttcactgccacttttagtattctgtttgctattgttaaagttgaaaacgaattttgggcaggtgtattagcttgctagggttgctgtaacaaagtactacaaattggatagtttacaatggcagagatgtattctctcacagctctggaggccagaagttccagatcaaaacgtgacaggcccatgcttccccagaaggccctaggggagaatccatccttgcctcttcagcttctggtgcgcttctagctgtcctgggcttggcatgttgctcttaatcactccaatctctgcctccgtcttatgtcacctgcccccttttctccctgtatcttctcttctgtctcttataagggcacttgtcattgggtttagggtctgggtacctggataatccagatgcttttatctcaagatccttaacttaattacatctacaaagaccattttccaaagaaagtcacatccccaggttctggagattaagatgtggatatatctttttggtgctaccattatacccactacagtgggagagagtgaaatcttctgatttttaaatggcaactgatttacacttttaaaaagtctgtgcagggactgggtgcggtggtccacgcctgtaatcccagcacttcgggaggctgtggcaggtggattgcttgagctcaggagtttgagaccagcctgggcaatatggtgaaaccccatcgctaccaaaaatgtacaaaaattagttggacatgggccgggcgcggcggatcacaaggtcaggagattgagaccatcttggctaacacagtgaaaccccgtctctactacaaatacaaaaaaaaaaaaaaaaagccgggcgtggtggcgggcgcctgtagtcctagctactcgggaggctgaggcaggagaatggtgtgaacctggaaggcggagcttgcagtgagccaggatcacaccactgcactccagcctgggctacagagccagactctgtctcaaaataaaataaaataaaataaaataataaataaataaaaaaaaacaaataaataaaaattagttgggcatggtggttcgcacctgtagtcccagctacttgggaggctgaagcaagaggatcacttaagcccaggaagcagaggttgcattgagccgagattgcgccaatgcacttcaacctgggcgacagagggagatcctgtctcaaaaaataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcccctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatgggggtggggtggggagaccgacaagccagcaggttgtcccatatggaatcgttgtccagtttctaccatttagagctatgttactgaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccagggagtggtgtgcagactcagtgaggcctcctgctaatgtatacaccctgaagtggctggtgagccccgctcttggcggggactttagcgtaatagtaagacgggcaggatcgctcactgggctcctgcaagcggtaggtcaactccctggagtaaaaagtttatggtagaactcagcctcttaagtccctggagtaagatttaccataggaagctgcttatcttagtgttttccaggtctctggtcagcagagatgatatcggaggggctggggtccagatggatgggttggttggggtgcccaccacctgtggggacccactagtttgcagcagaggcccgtagggggcatgccgaggccttctcgctgcaggatgctgagctgcagatgcccttgctcagctcgaagtagggtgggtgcaggctgaggttgcctgctctaggatggccagcagcagtgctgcagggccccaggggcagcccgaacagagcctcaagcagcgctttgccatcttcctggctcctagagcctggtatttctgtaagtaagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatctcacgaatcagcactaaagaatttactcatgtaaccaaacaacacccgttccccaataacctatggaaataaaaattaaaataaataaaaatgtgaactccaggatggggtattttcgatggcttttattctgttacctcagtgggtacccagtactggaattccacgtggcttccttaatgtcccactttttctctctttgtttctctattaaaggaaaaagtacccacctccatgatattccagagacctagagatgagggaaacctgtactttttgagctcactgccccttccactattctctctataagtctccatggccaacccctgtggcattaattggtgttctctatcctgatacctctcaaagacatcctaaccccttcttccccaagcccaggcttgtatttctaactgtgtagcaaacctccctgtgtgtttagtcgatacctcaaatgtatctaagatgatgatttcttcctcatatgaacaccaccaccaaaccctcctctcccctgtgtccttttcttccctgctgtgacccagttgatggatggtctcttggaagcagaggctgtagctgtcctagagccctctggctcctgcaggattacactgagcccctccctgtacctgccgcctctcactgtttttactgtggtccatcttttggggactacagcaaattggaactcatcatccaccgcctccggtggcaggctcctcagccagcaccaggtgaaaagttgcacttcttatctcctaaaggcctttgctgctgggccctgcctacctctgtatgacagttattgaagtttctaccataggcaccaattccagttgtacaggagacttagaattcttcccagaaggggtttttgagtgacaagagctgttcggaaactgcttcgaaaagcaataaacaaaaacaaaaaccccaaatgaactgcttagggttttcgttgttgttgttgtttttgagaccgaatcttgctctgttgcccaggctggagtgcagtggcacaatcttggcttactgcaacctctgcctcccgggttcaaacagttctccacctcagccttccaagtggctggaattacaggcactcaccaccacatccagataattttgtgtttttaatagagacgtggtttcaccacgttgcccaggctggtctcgaactcctggctcaagccatccacctgcctcggcctcccaaagtgttgggattacaggcatgagccaccgcgcctggccagcttagtttttaagagttttctacctggtctccttcctctctcacttggtcaactggtacccaccccgaggtgcctgtcctgaaacctcacctctcctacccatgcatgggcttggggaaaggacctgagccaccttttattcaggttctctattccctgcccccggaccccaggcacactttcccccctctatttctggttttatccctagtagcaccttaatccttgacactgccttctagcattctctgtgttcatgctagaaccacccaagtggataaaggggaccttacttctctattgttccttccccctctcctctctgctgctggtgaaggagggaaaggaaagatgatcctctcattctggtgtagaagagtttgtggactctggggaagaacttgatttctgaggtcacttaagggctgaaggtgaaaaattaactagttttgttttattttaaattttttatagagacagggtctcactctgtcgcccaggctggagtgcagtggtgcgatcatggctcacttaggccttgacctcccgggcttaaggaatcctcctgcctcatcctcccaagtagctgggactacaggcgtgtgccaccatgcttagcttattatttttagtttttttttttttttttttaatccaagcacactgtctgtattctctgaacagaattgatcttctaatttagtatttttcaaacatttctttacctataatttgtagtaggaggtaatcataaccctggaaataacacatctgtgtaaatgcaaaacaaatacatgcataggccgggcatggtggctcacgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacagaagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgacatctctctctctctctcttttttttttaatgccccgatacaattcttaagcttaaaattatattttcctttgtagctttgccaatttgagaatttacccacatggattggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaagggatagttggtatgggagagtggaattgggccaggcgtctacaggctgctagagggtaggaggagggacaggtcaatcttgcacagctctgtcaacatggcctcagtcgttgggtctgtaatttagttcttccatgcagcttattctacaagcccattgatttttcttttaattgtagattttgaacaaagtagaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgataagaaaatttgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcagattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcatacatttatgggcttcagcattcatgagaagtctggttcttttccttttttggtataggagttttctaagagtggagttaagctttagatcttcaaaataccttgcttatgcttgtcacagtttttattatcttttcatgaaataaggttgacgacagctagaaattgggtataccttgttgtaaaccctttgttactggcctcaaaaggacaaggattgctatccttttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgtgttcccgatgtgatgcctgtgtaatatatgtcaacctgattctaaccatgaagagtgagagattatcaggtaaacccacgagtcatttttcagcagaatagctggtctgtacttggagatatcagtgtcatgaaacataccagtaaaaaaaaaattatacgttacatgaggataaaaaagaaaaaaaaaacagggaaatgcagtgtatgagcctttattcaagagcagaacatctataaaggatataactggggacacttgaagatggactctgtactagataaccatatcatacccatgtgaactggtgtaaatgtggtaatgtccatgtagttatgtagatagtcttaagagacagatgctgctggagcatttgaaatatgaagtgtgcagtggccatcttctccttcagctttttgttagagaaaatctaaagcatgacaggattttttaaaaagtgaactgtgtacaatagttgtcaacatttggtggtggccgtgattatataaaactaaaagcccaagctttggattcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagatatcctttgttgtataagagaacaagttcagtgggcttcttttgtttccttccttcagtgtctcacaactcaaattaatgttaccacagactagaggcaaatgtgttacctagactgccttgaacagacaatttagtaacagtacccttttatgtggccatcaacaaagaaataatcagctgggcacagtggctcatgcctgtaatcctagcactttgggaggccgaggcgggtggatcacctgaggtcaggagttcaagaccagcctgatcgacatggcgaaaccctacctctactaaaattacaaaaattagccaggcatggtggcgggcacctgtaatcccagctactcgggaggctgagacaggagaattgcttgaaccctaggtggcagaggttgcagtaagccaagattgcgcaacttcactccagcctgggtgacagtaagactctgtctcaaaaacaaacaaataatctacctagttgaggattaaagagcaaaggactttgatactgtgtctgctgcctagcagtttccaaaatggcttctctaaagccatctcatgaggagaaaagaagattaagttccttttgagtgtccttagtgtgaaaataaagtcactgcctcattcatcattttgttaaatttgtgatacccaagttagtattataaaacctttgtttgtcttaatcctttctttaaagtattactatttcagaattctttgatatacccaaattctccttaacctgttgcggacattgaccaaatggtgattgatgggtgtaagaaatacatgcgaaaaacgtgtggcgatgtcttagacaatcttaaaggagactgctatcaggtaattgttttctggataatgtagttttaagtgaactaataatataagttattgatcagaattgtgccttattaaaacagcttttagtatagttggttgagaagataaatacatcatctgtctcttcatatgagttatatgtatatttgtatttagggtgcacacgtaccaatgatgggaaagcaccaactccagattctctgaattaaataaaattaattctttttttttttattatactttcagttctacggtacatgtgcagaatgtacaggtttgttacataggtatacacgtgccatggtggtttgctgcacctatgaacccatcatctaggttttaagccctgcatgcgttaggtatttctcctaatgctatccttcccctagccccctacccccgatcggccccggtgtgtgatgttcccctccctgtgtccatgtgttctcattgttcagcttacacttaggagtgagaacatgcggtgtttggttttctgttcttgtgttagtttgctgagaatgatggtttccagcttcatccatgtccttgcagaggacatgaactcattcttttttatggctgcatagtattccatggcatatatgtgccacattttctttatccagcctatccttaatgggcatttgggttggttccaagtctttgctattgtgaatagtgccgcaataaatatacgtgtgcatgtgtctttatagtagaatgacttataatcctttgtatgtatacccagtaatgtgatcgctgggtcaaatggtatttctagtcctagatccttgaggaatcgctacgctgtcttctacaatggttgaactaatttacactcccaccaacagtataaaagtgttcctatttctcctcatcctctccagcatctgttgcttcctgactttttaatgatggccattctaactccagcttgggctgcagagcgagaatgtctcaaaaaaaaaaaaaaatcttaataaaaaaaaaaaccttaataataataataaaaaagaaaccttagtagtaaaaatcaagtagtacacaaagctaaagattgcttttacatatgtacaaaatttccaagtaaaataataagctaaatctggcaaattaagtctatattatgctcaagtaggatttagttagaagtgtaaagatttcaattttaagaaatctgtcaacttaattcgttaggtgaataatttaaaggaggaaaataacagatgacaaagaatttgagaatatttagcagtcattttaaataaaaactaatgcagtatagccatgtaaaattagccaggtgtggcggcgtgtgcctgtaattccagctacatggaaggctgaggcaggagaatcgcttgaacccggaaggtggaggttgcagtgagctgagattgcaccactgcactccagcctgggcaacagagggagactgtctccaaaaaaaaaaaaaaatatatatatatatatatatatatttccatctaacaaatctgtacatgtacttcctgaatctaaaataaaagttaaattataaattacttgaataaaataaaattgcaatagagatgaaactacctgaacgttaatagaaacttaggttgtggtaaatagaaaaatagaaaatataatagatagcaaaagccatttccactgaaaataggaagaagatgaggatgcctattatctttttcaacattattttttgaggtagctgagatagtaaagtagatgaaaacagtataaatctaattatttgtagatgatgtgaatactagaaaatccaggaaacttacgtaggaaattatttgaattaatgagaatttgataaagtgattggataaagccagcctagattttttctctatactaaatgctaactcatttaaataggatttccttcccacccatttcctttcaaagtaatcaagtgttaaattcctaggaatatatttaacaagaatggtattgtgagactggtatgaattatgttaagatgttattgaaagacatcaaagtctgaatatgtggagaggcatgctgtatttcttgtattgaaagaacaggccgggcttggtggctcacctgtaatcccagcactttgggaggccgaggtgggtggatcacttgaagtcaggagttggagaacagcctggtcaacatggtgaaatcctgtctctactaaaaatacaaaaattagcccgacgtggtggtgggtgcttataatccagctactctggaggctgaggcaggagaattgcttgaacccgggaggtggaggttgcagtgagccaagattgcaccactgcactccagcctgggtggcagagcaagactccgtctcaaaaaaaaaaaggaacaatgtctattcttcccaatttattatgagtaatcccaaggaggggggaggggtttaaaagtagaccaactgattttgaagttgatttgtaaaaataagtatctaagaatacccaagaaaacttgaaaaaagaatcatagtgtgaagcgaaatatgtcctatttgttgttaatgtactataaggcacgataatcaaataggaagtatgaaaggaatacacaaggacctaggaatgtcaaaggaacttgaacaggtctgagtatgtattcctacacactgctaatatggtctaagatacatttcagttgacttgggaaaagcgttagttgagttagtgtgtgatgccggtataagaagttatccatctgcatgagaaccaagttagctaacaatagaaataggaattttggtgacttaggctctaaatgtaaaaactaatacatttaagacaatttagagtacttaaccttggagttcagaaatctcttaaagataggacactcaaactgttaatggtattataatgttgtcattaccaagccaaaagtcagactagaagaaagactagtaacaagcatgacagggaattgatcccttgaataatgcagagtccctacaacttagaaatgaagttagctaaatttaaaaaggtatagaggatatttactggtacttctcagaataagtcaaataacctgtaaaaagtaccacaagacaggccgggcgcggtggctcacacctgtaatcccagcactttgggaggctgaggtgggcggatcacgaggtcaggagatcgagaccatcctggctaacatagtgaaaccccgtctccactaaaaaaatacaaaaaaaaattagctgggcgtggtggcgggcacctgtagtctcagctactcgggaggctgaggcaggagaatggcgtgaacccgggaggcagagcttgcagtgagcccagatcgcatcactgcactccagcctgggcgacagagcaagacttgtctcaaaaaaaaaaaaaaaaaaaagtaccacaagacggtcaaccctgttggtggcccaggaagttcttgtgaaaacattagcaacagacttcacaaaatttagtagaggggcaatatctcatgctggggaggttgtggggagacaggtgctcatatgcattgctggttggcgtgtgaattgctatcaaaaccggaacacacggcttctagccggtgtttgagcacacagcccacagttaaaaaggtgtcactacaaggttttattatagctgtgcttgtagtgaccaaggcttggcaatgacaacagaaagaatgtttttagtggaatggtgtattttttaaaatgtgtgttattacctggagagatgttgggtgaaatgttcaagttccaaatgatgtgtgggattcaaattttacaaaagagaacatacatttgtgtttgtgtgcaagtattcgtaagaatctgtgtgaacgtatggaaaaaatatgagcatatcaaacaggattaatacatggattgaaagcaacggtggtgttagtacctcctatatttttccatagttggacttgtatgatgcattgaggcaagttataaaacaataggacagaaaagtcccagtttcttaaaattataactgtgaggctataagaagaatgatgagaaataacatgggataggttatcttagggaattgtggtgaactttttttaattttttttgagtcaaggtcttgctctgtcactcaggctggagcacagtggtgcgcgatgatcatggctcactacagcctcaaactcccgggctcaagcgatcctcccacctcaacttcctgagtagccgggactacaggcagataccactaggcccagctgatttttcttttttttctagagacgggctttcaccatgtcgcccaggctgctctagtactcctgggctccattgttccgcccacctcaacttcccaaagtactgggattacaggtgttgggccactgaccccagcctggcaaactcttaaactcttggtttctgactattatatttaatttttcttttacttaatgtattttttttttgaattagaaaactaaaagatgacagtaactcctgtttagttcaggatgttgcttagatccagatgtgtccccagcatagagcctcagtacttcaaagatacagccaacctcaaacttcttttctgtgttaactatatatgatctgtatgggaattccagctggtctctttattgactctgatggtgggagctgttatatatagctttattagcagtagcccaagcgttagagaaaattgagaaataacatgttaatagtttgagtaaggtgcaaaagtgaatccataaacaatgaagtcattcagtgcttagtataaaagaaaaattaggctgggtacggtggctcatgcctctaatcccagcactatgagagtctgaggtgggcagattgcttgagcccaggagttcaagaccagcctgggcaacgtagtgagaccctgtctctagaaaaactttttaaaaatagtttattaattaaaaaaataaaaattaaaagaagatgatacagatagtgataggagaggcagtatagattagagatgaaagtatgaagttggctttcagatagtaataggtatacttcgtggatctatgggcaagctggataacacctcaagtttgtttctgcattggtaaaatgggatgataatagtgcctctaggattgttgttttattgaaatgagaaggcatataaagcatatatggtaagcacttaatttttgctgttaacagacatagatgaaagttttttggttcctgtagcagttgctgtggatagctgtggatataagcccatacttggcgcttttttcctccttcctttactattgttttttgtttaactacatccacatgttggctcactcatctattcctgttctttctggaaggttctaatagaagactgtatcccggtactgaagaggtacgccaaagaagggagagaatttgattatgtgattaatgatttgacagctgttccaatctccacgtctccagaagaaggtagatttttttaaccaagatatttatgatggaaatgtttctcttggcaccatgtgagggtgaaaggatcctagagattgtgtagttctctcacgtttttgaaaaagggagttaaattgaggtccatggtggaaagatgactggatttggcttcaattcctgttctgccactcaatgagtgaactaattcagtcatttgaaacaaaaatgaagtaaaatgactcattacattaatgagacagtaaatcatttgacaatttatttaaattatgtgattttcaacctgtattggtacaaactggtcacttatctaagcaacgacatagataattccctttctcaaaccagatgtttgttccaaatcacagctagttcgtgtttttttctataaactcaagttcctgctgagtttgcaggctctgaatttctctcaggattttgctgcttgcccccttatttaaagcagttttctttcacgtttcagccactgcctttgtgtcaaatctattggtattttgagagcgagcagtgctaggtggatgtgattttggcatccaaaatcaatttcattatcgttcatgaacaagctctttgaatagtgggtcttacactcgtggctctttttctttttcctcttttggtattgagtattcgaatattttacttcagatgttgtggatacatacaaacccatatttatgaaacttgttcttttaaacattcagattccacatgggagtttctcagactgattcttgacctctcaatgaaagtgttgaaacaggatgggaaatattttacacaggtaggctacttaacagttttttccctcaaaacgctctaagactttcctgttttgaaatctgaatgcacatttttgaaatgtatatctattaaggatagagcggcatcatcggattatgttctttcaaacagtaagcttctacgttgacctgttgtctgttgggaattaatgagttatcagccctggtctttcgctgtagtatgagctgctgccaccagatggagacacagactgattttcttttttcccctcccctcatcaacatacacttgatgacaaagctctggctgtactgtgaactcctgccaccagatggaagcagattgtggtgtttttctcattctctaggggattctaaacttaaactttaaagattacattaattggggttaaaaatatacatatatatctcctattgaaatccttaacaaaattttgaaaatgacagcaaagacagctaattgataatccagtctcttggtacaaaattccttgatgcataaacataagataagcacttatgtagcattgcactctggatctctgaattattctgagtttacaggaaaatcccctccgccattttttaaaaaaagtactgccagcctggacaacatagtaagactccatttctacaaaaagtttaaaaaattagctgggtatggtggtgcatgcctgtagtcctaactctggaggctgaggtgggaggattgtttgagcctgggaggttgaagctgtagtgagctgtgatcgtgccactgccctccagcctgggtgacagagtgagaccttgactcaaaaataaacacagtattagtatactgtatttaaaagtcaggaagaggccaggtgtggtggcttacgcctgtaatcctagcactttgggaggccgaggcagttggattatctgaggtcaggagttcgagaccagcctggccaacatggtgaaatcccgtctctactaaaaatacaaaaattagccaggcatggtggcagcagcctgtaatcccagctactcaggaggctgaggcaggaaattgcttgaacctgggaggcagaggttgcagtgagccgagattgcaccactgtactccagcctgggccatagagcaagactacatctcaaaaaaaaaaaaaaaaaaaaaaaaaaaagtcaggaacaggtagaggttttcactttaaccttctgaggaggtgtctgccagcagaccctatcctggacattttatggaatctgagattactaatgctgaaaacaacttagcatttctgagagacatcttgattcaggctccagcctatcctgttgttcccctcttccctctgcgtgcaagacctgcaagcacattgtgcttaatcttggactttgcgcttggcaaaattgttcagaggctttgaggacagcaaagcactatcaatgaatggagtgtctctgccccccacaacatttagaaatgatttttacagacatgctgtagatggatataactatttaaagcaggagtctgcaaacattgggccaaatctggcctcctgcttgcatgtttgtaaagttttcttggcatgcagacacgcccatttattacatagtgtctgtggctgcttttgtactgagtagttgtggtagatactgtatgatctgcacagcctaaaatattttctatcagaccctttacagagaaagtttgctgatccctgtcttataggaaaccagtgaaacctgctcaaatgaagctttcttattgtaaagaagcaagttggacttatgatggtttttttttttttttttgagatggagttgcgctcttgtttcccaggctggagtgcaatggcgcgatctcagctcaccgcaacctccacctcctgggttcaagcgattctcctgcctcagcctcctgagtagctgggattataggcatgtgccaccacgcccggctgattttttgtatttttagtagagatggagtttctctatgttggtcaggctggtctcgaactcccaacctcaggtgatacgcccccctcggcctcccaaagtgctgggattacaggcgcgagccactgcgcccagccatgatgggtactttttaagcagagcatatggaaattttttcttttcatttttttgaggtaagttcttggtctgtagcttaggctggagtgcagtggcacagtggcactcattgcagcctcaacctcccagactgaagtgatcatcctgctttgccctcccaaagtgctgggatttcaggcatccattgccatgcctggctaatttttgtagagatgaggtctcactatgttgcccaggttggccttaaactcctagattcgagtaatcctcctccatcagcctcctgaagtgttgagattactgccatgagtgaccgtgcccaggcagaattttttcttttaggtttctgcaaatacataaaaggaaatctcaagcagcttaaattaatcaaggaaaaatgtgaggctctgggatcttgaacaaaaagagactgaaaaaaatttggatccactacaaactagtcagtctgtagtacaaaaggcaggacaaaagaagacagccacactaagtccacctgttgtctactacagccgagtggctgttcttcttttgttctgaatattggcatggcaggctgcctcctatggagagctgttatcttagtatgaaaggctaatagaatacttgcttagaatactaccacagcccatttgtgaatattaatgacccaggctttgatatcttgcctttgccaatagactttttaccaaaatcaaaaggattgtatgcccagggctgtcttggtttctaagaattgtccaaaagacatatgacatgttttctgtccccatgttcattacagttggaaccacaaaacagtctcattatgtaacacctggggttcattcagtacatttggtgattgacactgtcacatggtaagatttatgtggaccggcatgtatagccctttcaagaagtagtaattaagtcaaaaagcaagtgatttgactcaggatgtgttgatgtagttgccacagtgcagtttttttttaactgccaggtgacacgcttaggaggtaacccagattcttggcatgcccacccgctttgcccaagtgtgcagcttagaactggagtcaggttggccgggtgcggtggctcacgcctgtaatcccagcactttgggaggccgaggcaggaggatcacgagatcaggagataaagatcatcctggctaacgtggtgaaaccccgtctctactaaaaatacaaaaaattagccgggcgcggtggcagacgcctgtagtcccagctactcgggaggctgaggcaggagaatggcgtgaacccaggaggcggagcttgcagtgagccgagatcacgccactgcagtccagcctgggcaagagggagactctgtctcaaaaaaaaaaaaaaaaaaaaaaaaaaaaaaggagtcaggttaagggtgggatgaaaatgttgtgttttacaaaagctaaatgttcccacccaaaactgctagctgtgagttcgtgatgtcattggttttactgtggctgcctgaaggcagccttgtcagcatcccaggaagctggggaatgcatcgtggagggacgtgggaatcaaagtgggccaatagaatttgaattggggaggaagtgttttcatggaacctaggaggcggatcctgggacttgaccttcctctcttgtctccccacagccccatttaaaaaaaactgtaagttatatttctctctcctttctgcttgccttctagaagcaacccatctttggtctcacttttttccatttctgcattttatagatggttcttacatgtatgatttcctaaatcattatactatttaattttacttgcttttgaactggataaaagttgctaaggatgtattcttctgtacctgttactgaggtgtcatgtgcctgtaatcctaactactcaggaggattgcttgagcccaggagttcgaggacagcctgggcaacatagtgaagaccccacctctaaaataaacaaaagcaaatgtcacctgtccacacctaacatggggaaaagaactttctagaactgaagctatcgaatttggatttaatcccatagtgaagcctcaaaggggtaaagaaaccaatgactaataaaatctggactttgcaggattacgggtaaaaaaagaaacagcttgctgaaacactgaaactccctccacttaagagagaaaatcattggctaaaatctgttaaaaccaatatggccaattagaatttgcatagaacaagcttgctgatgtcacagcctaagtttccaccacttgcttcatgctaaccacttccccgccctcaagtttgcacacaagacccattagtgggcataaagaaataactatacacgcctgaggattttccagatctaccctttgctttccatccacgaatcaatcacctgcacatctcagaacctaccctttaaacttttttttgttgttgttgttgagacagagatggagtctcactctgtggcccaggctagagtacagtggcttgatcactgctcactgcaacctttgcctcccgggttcaagcacctctcctgcctcagccttccgagtagctgggattacaggtgtgagccaccacacctggctaatttttgtatttttagaagagatgggatttcaccatgttggccatgctgctctcgaactcctgacctgaagtgatctgcctgcctctgcctccaaagtgttagcattatagatgtgagccgccacacctggccccttaaaccttttctaataaaaggactgcccgtaagcccaacacagggagacatatttaagctggactcctgtctccttgttagttgacttacaataaaaagcttttcttaggccaggcacggtggcttatgcctgtaatcccagcatttggggaggctaaggcgggaggattgcttgaggccaggagtttgaggctgcactgagctatgttcacagcgctgtacttcagcctgggcaacacagcaagaccctgtctctgaaaagaaattaaaataagctttgcttttcttaaaaccccagtgtcctaatattgacttcaagcacattgggcagtgagcccctttttcttcgatagtgccaggtgtgaccccaccccttgttccatcccttcttcttatccttaatgagtgcttaattctttgctattagatttttattctgcatctcccatttgtttctcttaaaaagaaaaaatgtcattccatttaaatagacaggaaagtgaaatgtatcatgttacttttttggggtaggtgtctatttgtggtgtgtgttttcttctttgaaacttcttgacaatgttgggaaagaacaaattgaaactttcctattttcttaccacagtctgtgtaaggaagtcttcccatataacctctataaagagagagtgtggtgtcaattttaagatggcaaagccatttactgtgcaccttggtggcattttcattctatagcttccccagtggtgatgtgttctaaaaacaactgggcagttttctatttgtgaatcttaaattacacgtgtggtgtttatatgctcttacggtgaacttgatgttgaaaccaaattacatgctggcgaagggcactttggccatggccatatcccactgcaggaccctagatgatgggttactaaacaggctgacactgaaggatgacgtcacgttgagtgaatgtgctaagttaaaaccaccaaggccagctctcagaatagttctaacctcttgcccgtgactagctggctggttggttttgaaagccattctcaggagttcttacatcacaggctgcctttatttgtaaataattttcatcttgcattatacttggctattttgaggcaaattaatagtaactttttttttttctgaattggagtttcgctcttgttgccccggctggagtgcagtggcgccatctcggctcactgcaacctccacctcctgggttcaagcggttcttctgcctcagcctcccgagtagctggggttacaggcgcatgccaccacgcctggctaacttttgtattttttagtagagacagggtttcaccatgttggccaggccggtctcaaactcatgacctcaggtgatccacctgcctcagcctcccaaagttctgggattacaggcctgagctagcatgcccagcgaacagtaattttcttaagaaacggaatcagccacctggattcagtagtcttgtgaataccaacttcagagattaaaaggaaataggcggtattaaataccactttcgttttctaaattcataatgaaaagcatttggggaaaattgtgctaagaggatgataaatgcttccctagacttaatccaaatctacattttaacaagatcccctatgatatcatatgtacattaaggtgtaagaagcattgctctagagttaggcaaatactgtatccattcagcagctctgctataccttggctggcatctcttgattatcttcaccttttttttccttgtggtcacaggatggctgctgcagctccaaatatcacatctaggtcatagcttagaagaaagttgaagaggccggtggctctttctttgttcagaatcaaaagcttttccagcagctaccagcagacttccagtatatctcattgactacccctagctgctggagatgctgaaaatggggtgactgggaagggagaaatgttagaataatgaagttaagagaaagtttttgataaggtgtgcaactaggggatatccctatcgtatatatcctgaataaacttttgttctcttatacacagattctaggaaaaaaatgggggtgaatatagttctgtgtcaacattttagactcttaggagaattgtagtttaaaccattgtggaaatcaggaacactatatttttgatacttcatttgtaatataatggtgaccgttattgagaaaatttcctttgaatgagttatttgtatgaatctttgcaaattgcatggttttaattcagtgagtgtcactaataagaaattggtttcactgctttctatcatttcatattctaataatttgaaatggcttggtaaatgaggtagaaggataacgagctctaatgggtctataaatagaatgcagtgtgatttgtgaaaatacagaagccttatcttgtttttaaagatgaacttttatctaaagctagaattgttctcctttattaaagaccttcagatgagtggggcccttggaaggactcaagaatcccatttgcttatctctctttgatttaggggaactgtgtcaatctgacagaagcactgtcgctctatgaagaacagctggggcgcctgtattgtcctgtggaattttcaaaggagatcgtctgtgtcccttcatacttggaattgtatcctttgaccgtgacattctgttgccagatcaaagcacccaagtaaatcatatgccaatgaaaaaatttaaatcacaataataaacaattagcttagccatagagtatataaagccctggttctccagcttaggtgcacattggaatcccctgagaagctttaaataaaatctgagattctagacttccattctcaaaagttttggggtctggcttgccacagctttccaggtgcttttaatgatcaagcactactggtctaaagcattggttctcaaaggtgttgccagacctgcagcatcgctcaagaactagttagacatggacattctcaagccccaccccaacctgctgcccaatcagaggaattctggaggtgggggcccagtgacctgttctaccagccctcccagggatttatgtgcacctgaaaagtttgagaagccctagtctaaaataaccaccctacctgtggcaggtaaaatgtctaaagacactcattctactcttacattaaaataacctgacattaatactagtttctacacttgatgctaatttgcaacagaaatcgagaactagaatgatgttggggactgcacggttaacattggtgttctctgttagttccgcttagtaaagttagtctagagaagtaaaacacagaaagaaaaaaggaaatgagcattatcattggaaatttgtgccgcaacacagctgtgggctgtagtctgcagatgacggcttccttatctgctgttgccaagtccaggttcctgtgacggcagggtttttttgctgtcaagggagcaactgctgctgacctccagtgaggcctggtcccatcaggctggggcagagcccgacggggcaaactgcctgctgagaccagatggccagcaagaggcaatgagaaccctctagatcctccatgtgaggaggggagtactccgcctgctgggtggccgtgtccctccacagcctgtacagagcttcagcatctcctaccaactgtccacctttgtttagggttcccctcagcatttttgtcaggcctgtgtttgcatgttgggagatttgagaaatcagttgataacatttgaggcaaagtcttccacctgctagttcttctctctccctccttccttccctctcctttcctcctctgaccttttttccctctcctcctccttccctctcctcctcctgccctctcttccctcccccttctctcccttgtatctcccgctaccctaactttccctccctccctcctttcccccttccttcctttccttctcatactaattccctaaaacttgtgagactttggaagcagtagtgttacctgagagaatatttgtgttcctttagccttctgttgtctactcagtacctccttcagacctcccaggtggtgaggatgtccccaggctgcagagtggccttattcaaagtccttcgttctcattcccacagtgctctaagccatgaagcttttcatccatctttcaatttgtaggccagcaaacgaattacaagtgatgtcttttcttccttgaattacctgcttttattccttgactccctgtccaggtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagagacattttgtgtgttctgtcgttttatttcagcccagtcccctctttctgacttgtgatctcatagagcaacagtatctcctggtctgtttttagttctgtcactcgatgtcatttatctctttataataggatggccccggggccttttttgaacagtagtaatgacttcatttgccaccgtgctaaatgatacacaacctattacattcaccagtccttcattataccattgacctgaggctagcaagagattttgtctgactgtaaagttgaaagtcaaaagcttatttctggtcccactcttagcagtgtattagatgtggaaataaaagtcattttgggtagctgctatgaaactttctgagcagattcttggctgcaccgatgtatgacagaatttatggagaggcctatggcaatatgagcaacttgaaaactcctaaggaagtgcaggtagctaacagcttggtgtggtgtgtgtgggtaacaatccacatcaaaagtgagctttacattgacttggattgttagacatcagtgggttattctgttgtttttataaaaggtttatactgtatcaatggaatgagtcatttatgatgaatttgcaataagcaaagcattaaaaatgaaatattcagtgtccattttgaggtagaattggtgtcaacacagaacgttcttcctctcaaggtgtaggaatcaatagtatggtatttaaaaaaaaaaaaaaaaattttttttttgagacagcgtcttggtctgtcacccaggctggagcgtagtggcctgacattttttttcttaaatgagtgaatgtctactttttctttttctttctttcttttttttttttttttttttttttttgagacagtcttgctctgtcgcccaggctggagcatagtggtacaatctctgctcactgcaacctctgcctcccaggttcaagcaattctcctgcctcaggctcccgggtggctgggattacaggcgccggccaccatacccagctaatttttgtattttttagtagagacggggttttgccatattggccaagctggtcttgaactcctgacctcaggcgattggcccacgtcagcctcccaaagtgctaggattacaggtgtgagccaccacacccggccgcctactttttctttgtattagattgtcatggaagaagatgaagaagaaaggagttagtcatgttgtaattagatagacttaacttaaatttttcttgtgcacataggttaaaaatagcattagtagacattctccccatcccctccaactctactatagtgctttgcaaagctctgtgtactgtgtaagatataaaatgatggtactgttactgtagaacactgtttgggagtcaatagaattggatttttttctactttataaaagaaaccaggtatatgtacctgctgtctggatatcgtgtttttaataactgggcatgactttgtacttgaagactagcttgaggctggggcagcagatccactgataaatctgttgacacaagtcctgcaaagacctgagaggtggaaatgagtggatcaggttgtgccaggccatgggagatagattcaggagacagtaagggatgtggaataggaaagaaaggaatggaaatatctgtcttttcatttagggtgataatagtgaattttgacccaactcacttctttgtgttggagaaaggatgatgtatgttttgaacatctttgttactgttttaaaacaaaagcatgcaaactgaactctgaaaactgaaaatcccctctgcttttgctgacttttaaagaaatgttataagatctagcattgttgttttactttaatggctgtagtgttatatagtattacagtctcctttataacttaaactggaatatactgtagtatcctatagctgctttttaattagagacaagacaaatatgactgtttaaaattccatttaacacatcagcagatgtcaataatttatttaaaaagtgaaatgctgctttctcgtagaagtgtgattgattgaatattttagagacttgactaatggtgatccagcggggctagaggaaggctgggttgacagtgtttttaatgggctggagcagtgctgatgtcgaaataaaaatgtgctagtacttcctgtacagtctgcatagtcacttccttgcttgcattaactattgctgacgcaagactttgcatttctaccatctgtctcagtagatacatcaatttcattctggtcccatgactcctgggatagggtggggaattgtgggggtgtgggttttatgttaaatatcactggcctgtgttcaaggctctagagcaggaccagtcaaaagtgtagtttgtcaaccagctctttgttttctaagcgctgcacttcagctgacctgtttttcacagcaagactctcattgaaagaagcagtgtgctgatttttccccgtggcacaagctccttaccacatcttggagcagcatttttttgagaccgagttttactctgtcacccaggctggagtgcagtagcgcgatcttggctcactgcaacttccgctagagttcaagcaaatttctcgtgcctcagcttcccgagtagctgggattataggcgtgcgctaccacacctgactatttttttttatttttagtagatacggggtttcactatcttggccaggctggtctccaactcctggcctcaagtgatctgcccgccttagcctcccaaagtcctgggattacaggtgtcagccactacgtctggccttggagcagcaatatgagtactactcttccagaagccagttgggccgcattattgaatacctagttcatagataagagctgatatgtgaccttgaagaagtactctatctccttcaattaccttcttgccgcgtgtctttgtactaaatctttaaccttgctgttctttgggctaataaaccactttcatttacattatcctgctctgtcttaaaacagctttgtgaaggagatgttaataacactaggcaggctagcagtccaagtttgaaatgtgcctgagggtcccgtgaatccgggttccagcattcttaatttctaacatggatgcttccatcagaggtgcttaactgtttttgtaccttggactcattcagcagctgcctggtgaaacctgtgaactccttctcagaaacattttaaatacataaaataggattccaagaaacaagttaaattttccaaaaacttacgatagaatatttgtgctgctttatttgttacatagctagatcaagtggtgggtcacacaccataattgtgaagtagtaatacgcataagatctgtagcaactgaaatgtgatgaaaacacatttgatttgttgacaaagttacaggaactgctgtgtactaacgtggtttgtcacccgtgttcatgcttaaaggaaatgctaaatttcagtgggagttagtaaagataaagatagaaacattttcccatccaagtttatggggtcacagaattctgtccataggccccaggttaagaaatcctgacctacagtttttgcttccattgttttcattgtatttgagcggtgggggaagggtaggtgggatcccttcaccgttctgtcagaacctgaaatcaacactggcagatcagttctcctcagccagaaccatttaaaatctcaattacctcatgtagtcatcctactgatttctgctttactcattatttcaaaaatgaaaaatagaacatgggcaagaaatagcccagtgcttttggaaagctatttgaatcctcttggatgtgatttccctgggaaattggatgataaatgtgactggacaggtagacttagctcctgtatctgggggtcctgggatgctcaggccaactaattaatgcagacagttttcccatgtaccaaccaaccatgtgatcatttcagtgagcaatttttttatgatgaagcatcagggaatagacccttctctgtgcaactttgcacaggaatgtaaaaataagtgaattaggcagcctttctaggaaagaagcaggccaggtatattttaatggaaggcctccaatatccagagaagggagggttgggggttgctccaccccatttcctaaaaaagactggcaggaggtcagtctctgtagcccttggctttgaccatagagttacttattagagatcattcctagttccacctattagggaatacttttttcttgactttgttctaaaatagtcctaatcttggtaagtgattatgatggtagcttaggttcttgctgagtgattcagactgctcctgtctgttcattgctaagggacagaaacactccttggacttggtcacgcacacagctctacactacattccatgtcctcttatactttctagatgttctgtctttctccagtttaaatttggcacctgaaattccccctctgtccatcttcccaatgctaagggggagcttttgccaacatgtcccatgcattgcatgttcccttcagtgtttatattttataatcctcatcccatatctactgacgatgtatgtttactttttattattatactttaagttttagggtacatgtgcacaacctgcaggtttgatatataggtatacatgtaccatgttggtttgctgcacccatcaacttgtcatttacattagttattcctcttaatgctatccctcccccagtcccccacctcatgacaggccccagtgtgtgatgttccccgccctgtgtccaagtgttctcattgttcagttcccacctatgagtgagaacatggggtgttgggttttctgtctttgtgatagtttgctgagaatgatggtttccagcttcatccatgtccctacaaaggacatgaactcatcattttctatggctgcatagtattccatggtgtatatgtgccacattttattaatccagtctatcatcaatggacatttgggttggttccaagtcgttgctattgtaaatagtgccgcagtaaacatacgtgtgcatgtgtctttacagtagcatgatttataatcctttgggtatatacccagtaatgggattcctgggtcaaacagtatttccagttctagatccttgaggaatcgccacactgtattccacaatagttgaactaatttacactcttaccaacagtgtaaaagtattcctgtttctccatatactctccagcacctgttgtttcctgactttttaatgatcgccattctaattggcatgagatggtatctcattgtggttttgatttgcatttctctgatggccagtgatgatgagcattttttcatgtgtctgttggctgcatacatgtcttcttttgagaaatgtctgttcaaatcctttgcccaccttttgatgggcttgtttggttttttccttgtaaatttgtttgaattctttgtggattctggatattagccctttgtcagttgggtagattgcaaaaattttctcccattctgtaggttggctgttcactctgatggtagtttcttttgccgtgcagaagccctttagtttaattagatctcatttgtcttttttggcttttgttgccattgcttttggtgttttagacatgaagtccttgcccatgcctatgtcctgaatggtattgcctaggttttcttctagcgtttttatggttttaggtctaccatttaagtctttaatccatcttgaaataatttttgtatgagctgtaaggaagggatccagtttcaactttctacgtatggctagccagttttcccaacaccatttattaaatagggaatcttttccccattgcttgtttttggcaggtttgtcaaagatcaaatggttatagatgtgtgttattatttctgaggcctcttttctgttccattggtgtatatatctgttttggtaccagtaccatgctgttttggttactatagccttgtagtataatttgaagtcaggtagcgtggtgcctccagctttgttctttttgcttaggattgacttggcaatgcgggctcttttttggttccttatgagctttagttttttccaattctgtgaagaaagtcattggtagcttgatggggatggcattgaatctataaattaccttgggcagtatggccattttcacggtattgattcttcctacccatgagcatggaatgttcttccatttgtttgtatcctcttttatttcgttgagcagtggtttgtagttctccttgaagaggtccttcacatcccttctaagttggattcctaggtattttattctctttgtagcaattgtgaatgggagttcactcatgatttggctgtttgtctattattcgtgtgtaagaatgcttgtgatttttgcacattgattttgtgtcctgagactttgctgaagttgcttatcagcttaaggagattttgggctgagacgatggggttttctaaatatacaatcatgtcatctgcaaacagggacaatttgagttcttcttttcctaattgaataccctttatttctttctcttgcctgattgccctggccagaacttctaacactatgttgaataggagtggtgagagagaggcatccctgtcttgtgccagttttcaaagggaatgcttccagtttttggccattcagtatgatattggctgtgggtttgtcataaatagctcttattattttgagatatttcgcatcaatacctggttgattgagagcttttagcatgaagggctgttgaattttgtcaaaggccttttctgtatctattgagataatcgtgatttttgtcgttggttctgtttatgtgatggattacatttattgatttgcgtgtgttgaaccagccttgcatcccagggatgaagcccacttgatggtggtggataagctttttgatgtgctgctggtttcagtttgccagtattttattgaggatttttgcatcaatgttcatcagggatattggtctaaaattctcttttttttgttgtgtctctgccaggctttggtatcaggatgatgctggcctcctaaaatgagttagagaggattccctctttttctgttgtttggaatagtttcagaaggaatggtaccaactcctctttgtacctctggtagaattcagctgtgagtccgtctggtcctggactttttttggttggtaggctattaattattgcctgaatttcagagcctgttattggtctattcagagattcaacttcttcctggtttagtcttgggagggtgtatgtgtccaggaatttatcgatttcctctagattttctagtttatttgcatagaggtgtttatagtattttctgatggtagtttgtatttctgtgggatcggtggtgatatcccctttatcattttttattgcgtctatttgattcttctctcttttcttctttattagtcttgctagcagtctatcaattttgttgatcctttcaaaaaaccagctcctggattcattggtttgttttttttttttgaaggattttttgtgtctctatttccttcagttctgctctgattttagttatttcttgccttctgctagcttttgaatttgtttgctcttacttctttagttattttaattgtgatgttagggtgttgattttagatctttcctgctttcttttgtgggcatttagtgctataaatttccctccacactgctttaaatgtgtcccatagattctggtgtgttgtgtctttgttctcattggtttcaaagaacatctttatttctgccttcattttgttatttactcagtagtcattcaggagcaggttattcagtttccatgtagttgagtggttttgagtgagtttcttaatcctgagttctaatttgattgcactgtagtctgagagatagtttgctgtgatttccattctttcacatttgctgaggagtgctttacttccaactatttggtcagttttggaataagtgcgatgtggtgctgagaagaacgtatattctgttgatttggggtggagagttctgtagatgtctattaggtctgcttggtgcagagctgagttcaagtcctggatatccttgttaaccttctgtctcattgatctgtctaatattggcagtggggtgttaaagcctcccattattattgtgcgggggtctaagtctctttgtaggtctctaaggacttgctttatgaatctgggtgctcctgtactgggtgcatatatatttaggatagttagctcttcttgttgaatttatccctgtaccattatgtaatggccttctttgtctcttttgatctttgttggtttaaagtctgttttatcagagactaggattgcaacccctgccttttttttgttttccatttgcttggtagatcttcctccatccctttattttgagcctacgtgtatctctgcacatgagatgggtctcctgagtacagcacactgatgggtcttgactctttatccaatttgccagtctgtgtcttttaattggggcatttagcccatttatatttaaggttaatattgttatgtgtgaatttgatcccgtcattatgatgttagctggttattttgcccattagttgatgcagtttcttcctagcagcgatcgtcttaacaatttggcgtgtttttgcagtggctggtaccagttgttcttttccatgtttagtgcttccttcaggagctcttgtaagacagccttggtggtgacaaaatctctcaggatttgctcatctgtaaaggattttatttctccttcacttacgaagcttattttggctggatatgaaattctggtttgaaaattcttttctttaagaatgttgaatattggcccccactctcttctggcttgtagggtttctgctgagatacccgctgttagtctgatgggcttccttttgtgggtaacccgacctttctctctggctgcccttaacattttttccttcatttcaaccttggtgaatctgacagttgtgtttcttggggttgctcttcttgaggagtatctttgtggtgttctctgtatttcctgaatttgaatgttggcctgccttgctaggttggggaagttctcctagataatatcctgcagagtgttttccaacttggttccattctccctgtcactttcaggtacacctatcaaacctagatttggtcttttcccatagtcccatatttcttggaagctttgtttatttctttttactctgttttctctaaccttgtcttctcgctttatttcattcatttgatcttcaatcactgataccctttcttccacttgatcgaatcagctattgaagcttgtgcatgcatcacgaagttcctgtgccatggttttcagctccatcaggtcatttaaggtcttctctacactgtttattctagttagccattcgtctaaccatttttcatggtttttagcttccttgtgatcggtttgaacatgttcctttagctcggagaagtttgtaattaccgaccttctgaagtctatgtctgtcggctcgtcaaagttgttctccgtccagctttgttctgttgctggcaaggagctgcgatcctttggaggagaagaggtgctctgggttttagagttttcagtttttctcctctgatttctccccatccttgtggttttatctacctttggtctttgatgttggtgacctacagatggggtattggtgtagacgtccttcatgttgatgatggtgctattcctttctgtttgttagttttccttctaagagtcaggttcctcagctgcaggtctgttggagtttgctggaggtccactccagaccctgtttgcctgggtatcaccagtggaggctgcagaacagcaaatattgctgcctgttccttcttctggaagctttgtcctagaggggcacctgcctatatgaggtgtctgtaggcccgtactgggagctgtctccctgttaggctatacgggggtcagggatccacttgaggcagtctgtctgttttcagagctcaaacgctgtgctgggggaacaactgctctcttcagagctgtcagacagggacgtttaaatctgcgaaagctgtctgctgctgttcagctatgccctgcccacagaggtggagtctatagaagcagtaggccttgctgagctgtggtgggctccacccagtttgagcttcctgggctgctttgtttacctactcaagcttcagcaatggtggacacccgtcccccagccaggctgctgcctcgcagttctatctcagactgctgcgctagcagtgagcaaggctccgtgagtgtggggcccaccgagccaggcatgggagagtatctccttgtctgctggttgctaagaccttgggaacagcacagtatttgggtgggagtgtccactttttccaggtacagtctgtcctggcttcccttggctaggaaagggaaatcctccgacccctggtgcttcccgagtgaggtgatgccccaccctgcttcggcttgccctccttgggctgcacccactgtccaaccagtcccagtgagatgaaccaggtacctcagttggaaatgcagaaatcacctgtcttctgcatcagtcacgctgggagctgcacaccagagctgttcctatttggccatcttggaacagaagagcgtatgtttaattttttaatgtctgaagaagatggtgtgccttgggaagaatacagacacctgggtttgggttctgacagccacttaagaactggaggtttttaacttaagtgtagtgagggcaggagcagcaagaacttcagcccaagtccagctggcatgagctaaaatggaagctctgaaagccactgggtccttcttttgcctttgatgcttcatgcatgtagtaggcacttagtcagtatttccaaccttgggagattgaagcgtaccgtaaaagggaattcttagaattgcattttccatgtaggacatggaggaaacaggttggctggaagaagttacccatagctgggcttgctgaagaagaaaagcagtctgtgatgataaagggagaagtccccgcaaattcattttgctcaaaggagcaaaaatgtgtacttgacactagcaaaggtgcagtcccagtaatggtgaaagtgctgtgttggcgaaaggggtcctcaaagtccagctccttcctggttctcctaagggctgaagaggagcagaaactagaagatgtacagtggtcagactggaaaatggaaaaagtggaggatctgtagccattttgactgtcagccatttctgtgactgagtcttctctcttttctccttgtttgatcttcactgacctgagtcttgaatatctttattccccacccatttggatggagtttctgcaccaggcctccactttgatccgggccagcccacagaggactgtctttggctcaggtgccgacaccattctgcagaggccagggttcaaggccacacaactctgattttggttgcctgtgtttagtttgagcctggcccttggctctcacttgatgaatctactaaggatttgtgcatcaaaataattaggcatagtgatgaattataaacgttttaaaaattggaaatcatggccgggcacggtagctcacgcctgtaatcccagcactttgggaggccaaggcgggcagatcatgagttcaggagattgagaccatcctggctatcacagtgaaaccccctctctactaaaaatacaaaaaattcgccaggcatggtggtgggtgcctgtaatcccagctactcaggaggctgaggcaggagaattgcttgaacccaggaggcggaggttgcagtgagccgagatcgcgccactgcactccagcctgggcaacagaacgagactctgtctaaaaaaaaaaaaaaaaatcatgagtatgtatggataataagtaggacacaaagggggctcttttttactgtttagtggcaagtggttatgggagagggagtgctgaaattgaaaaactagtatttgataatcataatgaaggctgaatcaggcaagaatcatccattggtgttagatcttaagggaaatctcagcaaggatcatatttacatggctttaaagtatctcccatagattgcttatgagttgtgtatcagttccctattgcccctttaacaaattaccaaaaacttatttccttaaaataacacagatttctcttacagttctggagagtcagaagttcaaaatgcgccttagagggctaaaatgaaggtgttggcagggttggttccttctggaggctcctgggaaaatctgtgttctttctttaatttcagtctcaaagccagcagtggaacagtttcaagtctctctgctcctgttgtcacattgccttccatctctgtctcctgtgtccctcttgtaaggccacttgtgattacaagtcctacctagatgatccaggattctcttcctgcttcgaaatccttaaccagttcttcaaaatccttttgccatataaagtaacattcttataaggctctggagattacatggggtggggcggggtggcagggtgggggcatttatttcacctactgcatgttgcaagataaaagtaactttacagtgcagaaattggacaacatcttgaccaggtaatgaaaatcaacatccacaagggcaggtggacgtcctgtgcctccagaggtgacactctgagaagggtctgtcaccacctatgc

SEQ ID NO: 4419 - DNA, 10250 bp, human
acccaccacagagaatcttacataggttcacatatctgcatatccctatatgcacatttatgtctatatatgtgtgtatcactcaccagaaactttggcctctgaaaattttctcatttccaattctcctaagtaaatggaggccagccatgattctgactttggtccttagtaacgtccttaatagtgccagttatttacctgtagtttttcagctacatgcctaccctttcactctgttccgtaatgctggggactgggaatctgaaaactgtttctcaagctcctttgccaattagcttcctgcaaataggaggcactacaggaaattagtgggttgcagaagggaaaagggtgctgtgttgctgtctctcactctctctccccctctactccctcccttttctttttctgacaataactctggaagaatctttagttcctcctgcaaagctcagctctggagtggcagttctcctctactctcctaagtgacggtaccatcacctcctcccttctgtgaccctagacacaggagtcgcagctgctttctaaagttactaatctgtggtttatctcatttttccctcttcttgccttccaacatatttcatgtattaaattccttgtttaaaatacctagtgtgctttttgctttcctggctaatactgaaatatttccaaaattgggagagactcacttttgaatctatttctattaagaatcaatgaaatggaatactttattaggctgatttgaaaatgggctcatgcctacctttttaggctaacaggctttcctgcatgttgatgggggttcaaataaagggcattttatttcttcctgttcttttcaaaaactacaagattgttgttcggaaatgctttgctgagtacctcagtttaccttgtcatccttaaaaaatttctgattcctttgcatatttacctcttaattctatctcatttgcttttatttccacatgagcccaacttcaattttcaacatttctccttgaccttcgtctgatccatcaggtaatctcgctcctctttccttttgcatttgtgcctgatgaatcatatctccacctgtctcaaatgcagcatgctgtttttcatttgtaacagcctctcatgctcagagctcgtattaccagaaatttctcataggtcctatagcagtccttatctacatgtttcttaaaactgaaaacagtctcattgtgtaccaggaatacttcagtctttttgctattgccctcagtgacaatattacaatctatcatatcatcctttacctatttttagggtgggttttattcattttctctatcagtgatatgatttggctctgtgagagtcacaggagtacacagctgcgactcctgtgtctagggtcacagaagggaggaggtgatggtaccatcacttaggagagtagaggagaactgcctgccactccagagctgaggtttggaggagggactgaagtcactgtcagaaaaagaaaagggcggggcttgagggggagagaaagtgagagagcacaaatctcatctcgaattgtaatccccacgtgtcaagggagggacttgtaatccccatatgtcaagggagggaggtgattgaatcatgggggcagtttcccccatgctgttcttgtgatagtgagttctcatgagatctgatggttttaaaagtggcagttttttcctgaactctcactcttccctcctgccgccttgtgaagaaggtgcctgtttccccttcactttccgccatgattgtaggtttcctgaggcctccccagccgtgtggaactgtgagtcaattaaacctctttcctctataaattatccagtctcgggtatttctttatagcaccgtgtaaattgactaaaacaatcggtttctgaatacaaatgtctttttacttcatgtacctggaatttttttcactgtcaggtttttaaactgttaaaactcttgggcgtaattgtgtctgctttggcaatgagtcagatgaaagccatttcttcaaagaagtgattaaaaatcttggtgtgtaatgtcttcagttcaggccccagagaaacaaagaagcacagccaacatggcatcctgtttggcatctggtttcttttcacaaaagatattgcattcaatgggtccttaaatttggggctctgaacttagcaacagaatgccaacaaaacttgatcaactaaatattgtgagtaagccttaagttctaccttattcgattaaagcttgagactgctccatctgtatacccttttaaatcaatttgagggacctggacagtgcatgagttaattcatgaggactttttcaaaccaaaatagttcactaccacaagtgtgaattgaggatgtcatagctaacacatgtattgtgctgattgtatgttagggttcattctaaacacttcaaatatgttaacttatttgatcctcccagaaatcctatatgggagggattggtatgaccttcattcttcagatgaagaaaggcacagagaggatacataacctaccctaggtaacaaggtggtacatggtagactgggggttttactccaggcactttgactccacggtccctatttataacctctacatcaaactgtctctcaaaccttctcatccacatgctgactcagaatatataccaatagtatggagttacccaggttctcctgctaaggtactttgtgccctgatgatactcttcttagtagcaacagcagtttaacctgtggtttatctattttcccttttcttgccttccaacccatttcctgtattaaattccctgtttaaaatacctactgtgctttttgctttcctggctgatacagatatatttccaaaattggtagaaattcacgcttgagtctatttctattaaggatcaatgaaatggaatattttatatggctgatttgaaaatggaccacaaatggtccatattgatccgcaaagctaccctttataggaagtaggctatactctgagccagagtattatgccaagtgcttttacatttatacagtctcatctaatcttcccaacaatactaagacttggttattatatttccagtagccagataaccaaagggaggctaaccgaagttaagtaacctacacaggatgaaataactagtaagtacaagaagcagaattcaaacccaggcccatgatactggagcctgtgctcttaaccatttgataacatggccttccctctgctcttcttccaacagccctggtcacactgcccccaccaagtctccaccctgatgcctctgttcctccagcatagctgcctaaaaaggaccctcaagaatcccttgtctgattacaggcagagcttcctgagcccagatatcagtcctggctctgaaagtctgtgtggaactgaggagctcacttaaattattgagtctctatgtccttttctgcaaaatgggaatgaacatcatctatttcacagaatcactgaaggaattaaaagataatgtacatgaatatgtcaagtgcttcaatatttttagttacgataataataatgggattttcagcatcatcaaaacagtgtataataagatagactgagttttaggatgctatgaggcatcattattttcttccagagcaactgtatcaatattttgggaggctatatcttagagcccaatggaggaagattctaattaatgctttctctcacttttgaatagtcttgtaaaattttgatgctcatctacaaagctgggatcgttttcagatatgccacttgttgaaccacaatttcaggaaagagctatacctcagaactatagttacttaaagaatttcaaaagactacattttcaagaaaatctagtgaatagtaaaaacaggtttttttaaatgaggaagaaaaatcacttatcagaactatttgtaggagaggaaataacagtgcttgtgaatagaaaggcctgtaattaatacacctactggaaaatacatgtccaaaaatattgaaataaaaaagaattatgaccatttttcatcagtaacttactgcaaatacacaatccaattcacaataaattatagagtcgtatgtatatgcatttaatttgccaaaacactcataaagtttaatgaagttaactcccagcaggcagatttattactattcatttaatacgaatgaagcaaataaaaagtatttaacaacaaacatgatgcatttgccattagaacatgcccactaattgtaacatactcaatttgcttaattctttcttttatgatcaaattaggccaaacccaagtccatttgttttttggtacccactcagctacgcatcgtttctgacacttctttattttgaatctgccctaaatcttgtgatctgcctggcatattcaggctcatatctagccaaggaattaatcaaaagttggtgttttctggcatcaccagttttaattgctaggacttgggttagttgaaaggcacaaggccagtaaaacttgccagaaaaaaaaaagtacagtaaatttagcacttacagctttgaggtcttcattaacatgagtatcattcattataaactctggatagccaacttttgccaaaacagctctcgcctacaaaaaggaaaaagaaaaataatgtcagagtttcagcacttaaatcattaataatcacaagatgtagaaatgcgcccttcatctgaaaactccatttactgaatatctactatatgcaagccactgtgaagggcaaaaatatatagatatatattgagagacctcagtatactaaaaatgcagtgaatgtagcaaataactgtctagtacaatgtaaacaaaataaaaaatttaatagaaatagacaatattgttatcaaagtccagaggagagactgtttctgcatggagaaaatgcttaatggagaaggtgactgaatcgagtcttaagagaatggttaggatttcaaaatgtagagctagaagaacattccaggagaagaaacaggggcaaagacagaggcaaaaatatgtgcaaaccatacatctgataaagggttaatatccaaaatatatttaaaactcaactcaatatcaagaaagcaaatcacctggttaaaaaatggggaaaggaggtcgggcacagttgttcatgcctgtaatcccagagctttgggaggctgaggcaggaggattgcttgaggccaggaattcaagaccagcctgggcaacacagcgggaccctgtctctacaaaaataaattttaaaaaaagccgggcatggtggcacctgcctatagttccaattacttgggaggttgaggcaggaggatcacttgagcctgggaggtagaggctgcagtgaactatgatcacactactgcactccagcctgggtgacagaacaagaccctgtctccaaaaaaaaaaaaaaaaagaaattaaaaaattaaaaagggaaaataacgtgaaaatacatttctcaaaagaagacatgcaaattgtcaacagatttttttaatgatccacatcattactcatcagggaaataaaaattaaaaacacaatgagatattacctatcaccagttagaatggcgactatcaacaagacaagagataacaagtgttggtaagggtgtggagaaaagggaactcttgagcactgttggtggcaatataatttggtacagtcactatgaaaaacactatggaggttcctctaaaaattaaaaatgtaactaccatacaaagcagtaatcctacttctggggatatatccaaaggaaatgaaatcagtacgctaaagagagtgcctccatgttcattgaagcactattcaaaatagccaagatatggaattaacctaaatgtctattaacagaggaatggattaaaaatgtagtatatgtacacaatggaatataaaatgtagtatatatacacaatggaatactattcagctttaaaaaagaagaaaatcctgtcatttgtgacaacgtggatgaatctgtaggacttcatgctaagtgaaataagccaggcaccaaaaggcaaatactgcatgatctcattcatgcgaaatttaaagcagtcaaactcataacagagtacagtaggatggtggttaccaggggtgggggaatggggttagggagttggtcaaaagatacaaaatttcagttagataagaggaataagtttaggagatgtattgtacaacatagtgactatagttaatatcaatgtattgtacactagaaaatggctaagggagtagattttaaatgttcttaccacaaaaatgataaatatatgaggtgatggatatgttaatttacccattttctaatgtatacatgtatcaaaacatcatgttgtacatcatatatatatatataaaattttgacagtatatagtcagtttaaatacataaaaatgaaaaaaactacaaggagatagcaaacacacacgatatggcatattggagagagggcgagtaatttaatgtagctggactataagtacatgaggatggagaacagaaaataatgcaggaaaattggcctggggtcagatcacagggattcctgaatgccatgttaacaagcctatattttattttacagctaagagagagctaaatatgtttagcatgggaataaaaggagatgagtcatgcttcaggaagattatctttgcaacattgtgaaagatggccaggatgccagaaagattggaggcagtgatctagaataatttaagatacatcataatgtcataaccatcatttagatagacaaaggtactaattatcctctgtgttttataacagatagggaataaataaaggaaaaacaaacttaggcacatataaagaacctcaagagcagcgattggcaaaatatggtccctgggccaaatccagccaccctacccctgtttttataaataaagttttattggaacatagccacactcatttgtttacctgtcaactatggctgcttctgcagtacagttgtagagttgaataattgggtcagacaccctgtggcccacaaagcctcaaatattttatctggccctttctagaaaaagttcgtcaacccttgctttagagaaactttacagttccatgtgaaaatttctctctcccttctccagattctgggtttcataaaagcaaaagagaagcttacaagtacactgtcagggctctgaccagattccctgggatcccttttataacttctgtacatccctccagcatctatgttttttcttttctaatggccaacacctgagactttctgaaggcctgccctaggaactactagagctccttgcctgcaatcaaaaatagctagttcctgggggtttatttgccttctacccacttttcctgcacctgcacctccgcctccgcctctgcctccacccaagcagccctaagcggcaatatgaaagcccagcccccttgcctcaattcaggacaaactctgaggtataatttgtacttccaaagttccctgcaggatcagactagttctgagatgtctcctgaaattggactctcatccctccctgtcttgcttctcccattcccttactgatttctcttgggagtatttgtttaatgaatcacttacacaggaattctcatctccagatctgcctccagatgacccaacataagacctaggcaaccccaaacacgttggttttattccagcaaagccacaaagcaaaaccagtgacctctggacactgctcttggcaacgagttctttcctttagtccctttcaattttcctcactcaagaaataaacatagtaagatagtacactttccttaccttccttgaaataattcagatattaaatatcagcagaatcctgaagctcaagacttaggattttacaagggctgtaggacatagtcataatgggttttgctgtttcacagactcaagtatagcacagatcaaattacaccttcaaaactctgtgagttacacacactaaaagcttgatgtgacccagatagcagataactagaggttacaactctacccccaacaccaaactatgtcatacatctataggttacctcattctgagattattctattatttccggcattgtatttaattttgcactatattttatcagctcgctataagtcatatgcataactatagcaagtaaagaattccagatagttttggagagaaagtgagaaaaagagagagagagaaaagaaaagaagaaaagaaaagaacgaacgaacggacaagctgagtcatccacaattgttttctgaagactggtctttccagagcatgctggtgaattatgcattgttttttaaacctcatctctgggacccccactgcactacagagcctcacagaatatattaccttctgcaccatctatgcaggttattgaatccttttttattatttattgagcatcatcatgacttgaagataatcagaacacatacaaagaatccctatttacctcccaaagatacatacctagaataaggtaataatactagtagcaacattgccaacatctgaagagagtgttcttcttcctaaaatatgctatatatgtattcctctattcagattcaaatgtttttttctgccacagacttcgttgtcaattcctcctcatcctaccccaccccattctacatttttccctgagaagcttcagaaatacatcttgcaatatcccatggctccaggttagactgccaatgagaagcactcataggcaattccaaaggtagaagaggagatgccattcatttgctgttggtagccttatacagatatgtgggcatctgcagacagcagatacagcccttttccagcaacttccaggcattctcctgagaaagacctctttggtgtacaagcagcagagatcattgacagactctgcccttcactccccagccctctgaaaggttacctaagcctccaattccctgtattaaatgtcttgctggttgatatacttagaagagtgtctggtttcctgaatgaaccctaagtaaggcaaatagtaatcacatcactttttaatttttcaaaatgggagaagtgaagcaccaatagtttgatggcttgaagggcaaagtattagtgagtcaggtctgagattaattaccctattggttacatggacaaaaaggaaaggcaagtcccactgtaaatgctgagagagcagtgatataaatatttaacagattgcatattatatcctgcaagaaatatttcctaggctgtttgtggctgatcaaaaactccagggctttccatacccagtgcatgcattttcatgctttattcatacagacatgtagagagaagctgcacttgacagctggacatccgttcctcaatagaggaggtttacgcagctgctgatcttcactacctctgtgaccttaggcagagtacttaactttttgaaataaacaccgcctactgtctacctaataactattctccctttcttctcttactgtcaggactccaattctgctcaggatgacaatggactcaacaacaacaacaacaacaacaacaaaatagctgtgttgcccagcttcctttccaactggagtcagctacaggatgagattcgggccaatgacatttaagaaaaacttcttgttgcacttccaatgatccattttaaaaggggacagattcatcagcatatgctttctgcctcgagtccagggtttctcaacactttgggccagataattcttgctctggggtttgtcctataaattgtaggatgtttagcagcatctttggcttctacaaattagataccaggagcaacccatgcccccctccgcaagttgtgacaaccaaaaatatctccatatattgccaaatgtgcccctggtggcaaaatcacctccagctgagaactactgctttagcctttcctcttcttcctttctggaatgctgatgcaatgccagaagccgagcagccatctagtaatcacaaggcaacacatatgaggaaaaaatctacatgctgaagatggtgggatgaaaagctgatggcattcgaaggccagcatattagacctggactgcctccctcttttcccttcatgacatacagaaaataaagcccttatttgttt

SEQ ID NO: 4420 - DNA, 218868 bp, human; identical to SEQ ID NO: 3294

SEQ ID NO: 4421 - DNA, 215284 bp, human; identical to SEQ ID NO: 3295

SEQ ID NO: 4422 - DNA, 210242 bp, human; identical to SEQ ID NO: 3298

SEQ ID NO: 4423 - DNA, 150387 bp, human
ccatatggtgttttaggtaggatagggatgctctgaagaatggaggcatgttactttctgtgtttttatttgtttttttttgagacacagtcttgctgtgtcatccaggctggggtgcagtggtgtgatcttggctcattgcaacctctgcctcccgggttcaagtgattctcctgccttagcctctcgagtagctgggattacaggtgccggccaccacacctagctaatttttgtatttttgatagagatgggattggccaggctggtctcaaactcctgacctcaaatgatccacctgcctcggcctcccaaagtgctgggattacaggtgtgagctaccatgcctggctgcatttactttctgttgctgcttatttcctcttgtgtttttttttttttttttttaaaaactgtgtcacagagacaaattatgtactggggcatctgtttctgtgtgtatgtgagagtgagggagagtacaggacagagaaagggagggagggagagagaaaatgtaccgtatagaggaagaatttagaaggaggaagagaaatgcaggagagaaggagggaagagtatgggaggaagaaagagtatagaatagaggaagagtactggacagggagagagcagaatggggagagaaagacagaggggagagttcaggaaggaggaagagtactggagggggccaagggagtgagggtgcatattactgtgttagtgtgtgtgtgggtgtcgtccagatgtagatggtacagaacacatgctccatttgtgattaagacaataggtcaggccgagcatggtggctcatacctgtaatcccagcacattgggaggccaaggtgggtggatcacttgaagtcaggagttcgagaccagcctggccaacatggtgaaattccacctctactaaaaatacaaaaaaaaaaaaaaaattagccaagtgtggtggcaggtgcctgtaatcccagctactcaggaggctgaggcaggaaaattgcttgaacccaggaggcagaggtaacagtgagccaagatcatgccactgcactccagcctgggtgatagagcgagaatgtctcaaaaaaaaaaaaaaaaaaaaaaaaaaaaaaaagacaataggtctggatggcaatgatcaggagtttattttctagacttgagtagttgcatcttgaattattaggtgtgaaatcaaaagaaatgaatgatgctcaatctactctatctgcctttcttacttgctacctaaccgagattctctcattctgttttgttctctctcccctcagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagtaagaactttcacatgaattttactgtgacttttgtgttttctttaaattataagggcttcccttctcacatcctttgaaaactgtttttaaagaatgttacatcaaaagagtcatagggaaaatcccggtgtcctttgtgatgaactggccaaaagcactgtctggtgtaatttacttgctgcaatgataacaaatgtttttgccctttatttctggtctttctccatgctgttctctttgagatcctaaattgtttatgagcttggggagctagtcatataatgatgttattttctaaaatgtctgtgtgaacatctttttttttccccagttcattctcaatcttttgctgcttttttttttttttcctggttcctttttaaccattaagtcactttctggcaataaactaaagtaactgtattgagaagacacaagaccaccttgagagtggtagaaaaattgcacggataaaacaactttaggaactgccaggtttttcttattttaaagaatgttttagaatttgttgctttgctagtttattgctacaaagaaaaatcttccaatattccaggaaggagaattttacaggttccttaaggcattcagctttgactacagaaaatgaatcacagagcttacaaaatgaatcaacgagtttacaaaacactttactgagttaattgctgggccatgattaaaatcacattttcttatttggactcagacaaggctatgttgccagaagttacgttttttaaaaaaggcacaacagtccttggaagaaaatgtagcatttatcccctacggaaacacttagacacctgagaggagctgctgctctttttaagatactttctgatgataaaagtaatctgtgttcactgaggaaaacatacagaaaaaggagagaagaaacaattaatttacttaaaattctatcatttagagataagccaggattctttgaaaatgttctaaatggaaattgaatctagaggtacgtaattatattgcagggtagagccttgctccatggaccaggaatgtcagcagcatcacctcgggtgcttgttaaaaatgcagattccaaggccctcctccattgagtctgatccagtagagctggaggggaggccaagtaatctttattttaaacaagtacctcagaagaatcttatgattaacttttcttaggggaggggaaggggatcactgtattagaaaatttctttgtaagtacttcctagctctcaaatactataaaatatgacccaaacgattttctactcatatgccattgagttacggagcacattttaaattttggtggtaatttccattgaaaggtggagtttggcctgctttagattcatccttcacctcgtgagtcagtttcttctagtatctgtgttaaaagagtaggtacttctgaacactgattgattttacttccaaaaaagcctaatttacaatcaggggatagattgggatttggtttactgtattagaaaaagcatctctatcgtgatgattttacttggtaattgcaggacctttcataacaatggaaaagagcatgattggagggagattttactctgattcttgtcaaaatgataacttggacaaatataaacgtagagaacaacagtagaaaaaacatagatggaaaagtcaccttagatgttatgtacacatacaacttcatttaaaaataaggacaaaaattggccaggcgcggtggctcacacctgtaatcccagcactttgggaggctgaggtgggcagatcacttgaggccaggagttcaagaccaacctggccaacatggtgaaaccccgtctctacttaaaaaaaatacaaaatttagctgggcgtggtggctggcacctgtaatcccagcgacttgggaagctgaggcaggagaatcgcttgaacccaggaggtggaggttgcagtgagccaaggtcgcaccactgcactccagcctgggtgacatagcgagactctgtcttaaaaaataaataaataaaaataaagccaaatcccaaatctctttcacacagtttatccctcaaccaccagtttataaaaagcaacttgtgttctgcgtattcttgtgagatttcaatacaacgtacacatcatgagaagtctgacagcattttatttgcagactatggtgatgttttttcattgatgatcgtgtttaatcaccactcgtgtagcattacagggctacttgaggaaaagtcttcttgggttcccataattgccatattggtcaggatatgccagttgctataaccagcacctctaaacactcattggctaaattgtaccctctgctcatggaacagtctgaacatgggtgtccctgtaagagagctttcttctaaatagtgacttaggaagccagactcctttcatcttatggctctgccctcccttggatgtttggcatcctctctattcagctggaggatggagaaacagagagggtggaggattgtataggttttggtgggaaggcctagaagtggggtatgtcacttctacccataatccataagccagaactcagtcttgtgactcatctagctgtaggggagactgggaaatatagtttagctatatacccagaaggaaaaggagttggagtttccctagacatgcctttatcaaagagcctatctcattttcttgaaatgaccacttttctctcaatggcaaatacttccctgctccctacctctatgacactgtgagcacctcatggcaggcactcttttttaatttttaatttttgtgggcacaggacatattttgatacaggaatgtaatgcataataatcacatcaaggtaaatggggtatctatcccctcaagcatttgtcctttgtgttacaagcaatccaattatactgttttatttatttaaaaatgtacaattacactatttttgactatagttacctgttgtgctagcaactactaggttttattcattctttctatttttttgtacccattaaccatccctccttccctccttcccctctgctatccttcccaacctccagtaaccacccttctattctctatctctatgaattcaattattttaattgttagctcccacagataagtgagaacatgtgaagtttgtctttctgtgccaggttatttcacttaacattatgatctccagttccactcatgtttctggaaatgacaggatctcattcttttttatggctgaatggtcctccgttgtgtatatgtaccacatttttaaaaatccatttatctgttgatggacacttaggttgcttctggcaggctgtcttgtgattgcttttttaagtgttgtgacctagcacagtgcttctcatgtagtagacactttaaaaattctagaagttaaccagataccccatcaccaccacaaggaggtgacatatgaatggaaccccaaaggataaagaggaattttctaggtagggaagaatagagaaaaggggatggtaagcatcttcagtggtggaaccaatgtgaacttgggtgttgcctgcaaggcagggggctagagagctgagaggccagcttgggctcaggatatgtagaggaaaagcatcagatgaatgttctgaggatccccccacctcctacctttcccttggaggcaccattgaagaaaaagccagccaagccttctcacattgggcatctctgctgtgcctctgtttcgagaatctgcctataaaaatcatatacaggtaatggtgatgttaaccaccactatggttaacatctttgatctttacaacaattctatgcgttgttcccactttacagatgaggaagctgaggttaagtgacttggccaagatcacacctctaagaggaaacagagctgagattctaaatggggtcaccctcatttctatgtcttgtctctttttttccataaatgtcttggtgtgaaaagagatacttttcagatgcttcactgctcattttggagatgctagcgtattgtaccctcagctagttagatattgctagctttggcaattttcctgcaatgttcagcagttcaaagccatcctgtgttggtgtcagctgttcatttcttattttttatttttatttttatttcaataattttgggggaacaggtggtgtttggttgcatggaaaaattctttagtggtgatttctgagattttggtgtacccatcacctgagcagtgtacattgtacccaatatgtagtcttttattgcttaccccctcccactctccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacatgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcatttttcatatgtttgttggccctttgtatatcttcttttgagaattgtctattcatgtcttttgcccactttttgatgggattgtttgtttttttctttcagctgctcatttctcaattgctgcttctcccttcttatattactcccactgccagtctaggggattaggcctctttctctgactgagtggctgtggggacagtggcactgactctttggtaggtggtgcatggtacagaattagagcaatgagatcctccagtggtggtggtgccaaaccacaccagcccttgcagtccaagggggtaggtggccagggagggacccttggaggaatgagctggaggctgcctgtggggaacaagagctggtgtttgaggtggaaaggggggtggggtaaggaggtagtgatgatccctcatgttatgtgcatctcttcctaactacatgttcggtgatctcatgttgatagtttcaattcaactatgggggattttgacaccatggaaattggcaaatgtaacaaatcatttttctttttcttgacaaggcagttggcaacctttactagcacatcactgggtgaggggcactatagacttctctccctttctgtccccctcaattctcctcctcactcctgactcgaggctgcctcagacacttcccatctacttttatctgaggagtaagagtgggaggaggagaggccaaggaaggttggcatcaggaggagctgacgtgatttcctcttgcaggccagggctggatccatggagatcatctgcgccaggactgttttcttttgttgttgttgttgttttgttttttagcagactggcctagagcaaacccttggagttttgtcaaggaccctgtaagtattcctgtctttagttttattttcatataaagcaagtacaatgtacattaaagtaagatgattcttgttgcatgttcccaaaggatgacctggaaaatgtgctgttatgtggacctctcctgggggccagctcttctgagagtgatctagggtcttgctagccaaagaatggcctacagatgagcagcagagacattactggggagtttgtcagaaatgcagactctcgggctctgccccagacctactgaatcagaggctgaaattgaataagatccccaggggactcatatatacattcaagtttaagaagcactgatgtgggatttaggaagtcctagttgagctgtgtgtgcagaacgatgcggagatggagttttcctagaccagctgttttcaaacctgacacgcctcagaatcccctggagggtttgctaaaatacagtctgctggccccccaccccacagattctgattcagcaggtctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataataataataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtttgatttattgccacttggggaaattaccatatggctgaaaatgtgtttttttgggaaaaaaggatattatgtgttattttcaaggactgttgctgactgtgatttttgctttttgatatatctgagcattaggtgacagtgattcagtcattatggttatatctgttcctggcgtggtaatattagcactccaaaactgtgctccatagcattctgtcagtgtatttataacacactgaagaaactcatcagtgccattgtctcgctgtgtgaacttctcagcattacagcttccagcttgcagaggtctggttgttatgctatcacctttgtaatgccttgtccaggaagtcctcgtaattctttttgtgcccacagatttctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcatgtggacttttaacaacttccccaggtgactctactagtttgagactcactgaatatgtgatcgtgagtttacttaatggttctaagcctgaagtctcctcatatgtaaaatgggtataataacatctctcttacagcagcactgtgaggatcataattaatgtgagatgcctaaatgggatgatctcaggggagctggaagggcccctgcttctcaaaccccagtatactttgccatactacatcttccaccaccaccattgggccccctaacaacttccctagttattctggctcatcaccacccctttgagggaatatcttttgaactgatgaaaggacatctgctggctgttgacctccttctcgtctccacctatggatccagcatggttcacatgcctggtaagaggtattttagagacaaagaacataaagtccttgcactaggaccaagatcggcccattaatgtgctagacaccatgacctggtcgctgtctgcatctccccagtgtggctggcctttctgcccacttccttgagtgatgatcctgttcaccatcctctccaacatatcagccgattccaccattatttagcctgtccagagttcacgttcctgtttgcaacaccaaagccttttaacctttcggcatgcttctctcatgaagcctactcttaaccctcagtttgagatgtactatccttacagtgaagtgtctggcacatacttttgggtgctagtgtctaccaaatcattatttatgcacttgcctcatctcccctgctcagctaaaagcttcaggaaatcagggactatccatctccccagcacagagaactgttagtatatatgtgggtgctcaggatgtgttgattgagtgaatgaaagaaagacccttatgtactgacagtgtgtcccttcaattaaacaacccaattacatgaacaagctgaaatctgaagtcctgtgttcccagctggactttgagttctctaactgtaggtgctgggttcttacttctttacgttcctcatggcatctggcacaatacttggccaacaataagtgctcagtgagcacttcttgtcctattaaggagtggagatgtgaatgcaaaagagccaaaggaatgaccccaaaccacttagtggcctcaacagagatgggcaagggctggactttgctgattagtgcagtggtgtcttaggggaatgcgcatatcctaacaagatccattgggtctgagaagaacattttagaacttctatatctttatttaaatttaaaaataattaggctttatacagagtggtataatggactttggagactcagaagcagggagggtaggaaggggatgaggcataaaaaaactatagattggatccagtgtacattacttgggtgatgggtgcactaacatctcagacttcaccactatacaatttatccatataaccaaaaaccatttacatccccaaaagctattgaaataaaaaaactttataaagaaaaataattacactttattgagttctatattgatggctatggacccttcatttgatctgtatggaacatgtgagaggggcactgtcaccctcactggcttgttttcattcaatatattaaaaataatctcagctgatacggtggctcacgcctgtaatcccagcactttgggaggctgaggcgggaggatcacctgaggtcaggagattgagaccagcctgaccaacatggtgaaaccccatcagtactaaaaatatagaaattagccagtcgtggtggcgggcatgtgtaatcccagctacttgggaggctgaggcaggagaattgcttgaacctaggaggcagaggttgcagtgagtggagatcgcgccattgcactccagcttgggcgacagagcaagactccatcttcaaaaaaaaaaaaaaaaatcttgagcggtttacatatagctgtggatttatgaattttattatctagtttatctagtttactacttacaaagtagacaagtggcttaaaaattcttgcaggaaacaggaattgaaatgattattgatgatgtaagcacaagagaacagctagaaattggcagaagtgacccttctcccaggctggtatgccatgttggttagccagatgacaaaagaaatacaatggtggtctaacaagaacaaggacaatggcaatctgacaaagacatgtcatacatttttgaaatagtcaagaagactctaagaaatgtggatttatattcattgtcattgttgtattaaccaaatcctatatggacactgtgtcttgaagaattaacccaatggtgtttgaagaattaatgacttttgaagattttaaatttcattttacctcatcttttgaaatttctgtttttgtatttgttaaaaatattcctaatatattagtctattagtatatctctatagaaattaaacatccatgtattgggtgtgtatgctgaaaaatattttactagtaggagcgcatgtccactgtgtcagaatgtcatacaaatgagagtgtagtttgttcttgatgggcttttagcatcatcatgtcatattgctctcatgtgattggctcaccagaaagccatttcaggaatgtgtgttattagtcaccatggtaatggcacagctgggaggggaatggatcattaaagatccatcatcactattgagttagaaattaactgagatcacacattcttctgaggtcaggtcatcttttgcttatagaaaaaggcaacccttaaaatttaacagatttttaaagatatgtattataggcattacatgagcttatgaggttgttcatacatttggaagtgaaagacaaaaccctagaaattgactatttgtcaagcattttgttatttatttgaaccctgcaacaactctgtaaggtagggatcatcctcattgtatgaaaaataaagataaaatcacagaccttaagtgacttgtcgaaactcacatatttagtaagtatagaatgagggtgcaaaattagatgattggtattagccaatattttgctgttagtttccaaaggcaaagaatacataggcattgtatcaagtcacctaatccagtaagtcctcacttaacatcatcgatagcttcttggaaactgtgactttaagcaaaatgacagataatgaaatcaattttaccataggctaattgatgtaaacaagagttaagttcccatggcatattcctgctcacaaaaacatcaccaaacttctaaataaagaccaaaacacttctaatattgaacattgaatacatgtgagctatgcgtacatttaagaaagacaaataaaagcaagtaagataattttttttgatctttggaacccattcaatgtttttgtagacatattcttttttttatccttgttttcattttttaaattatactttaagttctagggtacatgtgtacaacgtgcaggtttgttacatatgtatacatgtgccatgttggtgtgctgcacccattaactcaactcgtcatttacattaggtatatctcctaatgctatccctcccccctccctctatgcagccataaaaaatgatgagttcatgtcctttgtagggacatggatgaagctggaaaccatcattctcagcaaactatcacaaggacaaaaaaccaaacaccgcatgttctcactcgtaggtgggaattgaacaatgagaacacttggacacaggaaggggaaagtaagataattattaacccagttattctagttcagggttgcaggtgctggagcctatctaggcagctcagggcaccaggcaggatccagccctggctaggatgccatcctgtcacagggtgcagtagctcaccatgctcactcacactgggaatgtgtagacacgccgattaacctagcaggcacatctttgggatgtgggaggaaaccacagcacccagagaaaacctgtgcagacttgaggagaatgtgcaaactctacacagacagtgaccctggcccagaattggttttttccttatcaactgtataacaaaaggatgttgaatgaaatgatgttattcgaggatctgctgtaatttgaaggtactcacaatttccagacacgaaaggctgtgtaacagtggactttataccctgagagtgaaagtaaaatgttcactctgagggctggagctggaatctttccttcatctatctctgttaggtggtgaaaagcaagccaattttggttgtgcttattgacattgtatcatcttatgtcatttctcaagtgaaagttctgcatttttgtatgagtaagaggtccctcgatggagctttgccaactgtttctctcaagatgttctgcagagcatcagatattgacctaaaatacaataaatgggcatctctctctgttaacaggaccattgccaactatttggtgtggagaatggtttattccagaattccaaaccttagcaggcgctttcagtatagatggctggaattctcaagggtaagtttaagaagattgcagtgttacatcgctggataactttacatgctggaatagtccatatattaactgatccagtaaaaatcatctttagggattagacagggggagtttgtagcccaagctctattgtttttgtgtgtgtgtgtgtgccttatttatttttatttaggtataaattacatatggtaaggtacactcaagttttactttgatgggttatataaagatatttagagaaatacttgaggccacacattgttttcaaacttccccgtcttattagtgtattcccattttcccccagagtttttaactgggtcactgtaattatagttttaacatttctttgtgatatatttgtaactatcttttattctcagtattctgaatatttaaaatgtgcatgatagagatattggatggtagaacttcattttcaatttggaaatggaattttgtcttaaactttgcctataccttccatctttgaatctatcctctgctaggtccaagaggctccaatttagttttcttgctcaactgtctgagatggttttcctccacctgctcacctggctctttatttatttatttttattagagatggggtcttgccatgttgcccaggcttgtcttgaactccagagctcaagtgatcctctcacctcagcttcccaaagtgctgggattaaaggcacgagccactgtgccgggcctcacctggctctttaacctttgcttctctcccacccttgctcgtctcccagtttgtacccatgttactctcacctttgtttttgaggcttatgtctgactaattctcctaccactagaggccgtaaggattttgtatctttgaaacagtttttatttttctatcaatttaaagttaagtgaatggtgaatcttataagctatgatttcattcaagaggcattttagttattagaggaactaataagtatagaaattcttagtgggccattactctggaagagtagtgcaattattttggatatgctttgaccctataaagtcactagcatataaagttactttagggctgggtgcagtggctcacacctgtaatcccagcactttgggaggccaaggcaggcaaattgaggtcaggagtttgagaccagcctggccaacgtggtgaaacctcgtctctacaaaaaatacaaaaattagccgggcatggtgtcacgcacctgtggtcccagctactcggggggctgaggcaggagaattgcttgaatccgggaggcggaggctacagtgaactgagatgatggcaccaatgcactccagcctgggcaacagagcaagactccgtctcaaaaaaaagaaaaaaagtcttttttacagagaacagcataaaacaactatatatatatttaggtcatattgatgggttaagatacaaaacaagtaggttttgtgtgtgtgtgtgtgtgtgtgtgtgtgtgtgtgtgtgtgtgtgtgtgtttgtgtgtatttttaactgctacgaatcacataaaagatgatgcccagctgctttccacccctactgtgaagagaatgagagaggtgtaagaagcactgtgtgaacatttaaggttaggtatgaggggatgtttcttgagcacgaagtgctaaatataatattgaattgccgaagaaggttgtaggatctctttctctagaggttttaaaaatagattcatcgcttacctctgagagaggttaccagaaatcagaggaagaatagatgaaattaagccttaatcccattcctcaaaacaacctgggtctaacattgtgcaaaggacacttctgaccaccattctcagggcctcccttcctccctgcctgcacccccagcttccaagggcaacttacactatatttatttctctgcttttattcccaagagtaaacctctgacccaggtcctgcttgggaaacttcttacttgtttgtaaatgttttcttgcaatggtataattgggacagatgggcaaagcatttacatctgtattttgcttgtttatcagtgtgttttttgctgtgacacaatgtaaatatgctccctgtgttgttcatggtgggccatgttcttctggtctgccttgttgagtgtgctactcggagcaaggaaaccctcactgggcaggaactttgatcacccactgattctagaccttcttagtggaactttagttctcaggagatattaaatattatctagacacttggatagcatcctctcatgtccctgctaactgcagaaaagtgataccattgtccagattctttgtttaatggggaaaattgggaagaaaggatacatatattattttaactgttaaatcactttcttttcttcttcttctttttttttttttttttttttttccagacagagtctcactctattgcccaggctggagtgcagtggcccaatctcagctcactgcaaccaccgcttcctgggttcacacaattctcccacctcagcctcccaagtagctgggattacaggcatgcaccaccgtgcccggctaatttttgtgtttttagtaagcacggggtttcaccatgttggccaggctggtctcgagctcctgacctcaggtgatctgctcacctgggcttcttaaagtgctgggattacagatgtgagccactttgaccggcctaaaacattttcatttagtttgaaatataatggggacaagcagaatttttttcttcaactattttacctttgcctctactatctgatgcatatatatgggttagggtgtgcagtgttttgtagactgttttcttcaggttgtttgaattgttttcagccatgggttttatccaaatgaagtttaatctggatcaattatctcccacaggtaatccaggggaccacaactttgctgcctcaatgggacaaatgtgtaaactttattgaaagtgccctcccttatgttgttggaaagatgtttgtagatgtgtacttccaggaagataagaaggaaatggtaagtggtactccccagctagcaaaaaataatggcaatttagccagatctgacaagggtatattcaacaggctaatgtcagccttccaggtggtagtggcctgtgggtattgtcttcagattctttcaacttctaagtgaaataggaagaaaggtcatcaaacgagagtgaggatgagttagcaggtattgaaggttagaggagagagaaggtgtgtagttttccaggggagtgggagagtgaataaactgagggaatgtagtatagctgcttgagggcaggcatgtccagatgtaggtgaggtttgaggtattgaatttaaagagggactcatcactgtggcaacgtgttcttctccatctgtttcaactgcattggagaaaagggtgtatttttttttctttcagctttattgagatgcatttgactaataacaattgtatatattcgaagtatacggccgggcgcagtggctcacacctgtaatcctagtactttgagaggctaagccgggcagatcacttgaggtcaggagtttgaggccagcctggccaacatggtaaaaccccatctctactaaaaaaaatacaaaatttatctgggcgtggtggcaggcacctgtaatcccagctatttgggaggctgaggcaggagaattgcttgaaccccggaggcggaggttgcagtgagccgagatcgcgccactgcccttcagccaaggcgacagagcgagactctgtctcaaaacaaacacaaagtatacaagatgatgatttgacatacattgtgaaatggttgccacaatcaaatgaacacatctgttgtcacacttatttaccattgtgtgtgtggtggtgggggatgaggacacttaagatttactgtcttagcaaattcaagtatacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctggctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctattttccataatggctgtaccagtttacattcttaccaacagtatatgagcgtttcctttttttccaggaatattttgccaacacttacctcttaaatttttgatcatagccatcctaacaggtagtgaagtgctatttcattatggtttgatttgcatttccctgatgattagtgatgaaaaccttttcataaacctcctgtttatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcaaatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgaaccactgcccatatacaaagcctggaatgtaacaaagagcccaccaagagttttgcctaggcttttcctggatcttgaagcatgacaagataatgaatgaattcttaacaggacccttttaggattaaacaagttttattgggggtctgaagaaactccacaggcctccacaaacaagtttactggggtctaaaggaactccccaaacctttatgatttagcaggagacaagataagggtaattacctcagtacctagacccatttagattaagtaaacttactgaggctccagaagaaggtcttcaagactcacacctagttatagattaaaagaagttaatcatttatgtctttcgacgattgcacactttcacgtagacatatagcttagaaggtatatgagctctagaaaactttgtaactttgagttggtctggtgataatttccaggctttctccctgtaaccagtggcagaaaataaaactctgttcttccccagttcatttgcatctcgttattgggccgtgagaaatagcagcctgaccctcagtttggtctgggaacaaattgacctatgttaacttgtttttactgtctaactatgagactttatgtttgaacctgaaagttcccttgcaaataattccactgaggaattaatggcttatttcaaaatactcagtattctcattgcgtgttttcttttgctctttggtcagagtaaatagattgagatcttatcagataatcacagtagtaatattataatctctgggaaggctataaaaacaattaaaggataatgaaagatttaaaaaaattatagcaggttttttggcagtagaagaattttaactaatatgaaaagtatgtggattaaacttgtttttctcagttttggtgtgaaagtcccttttccttgtgtcagggtatgacattctaaaataaagttaattttggcatcttcccccttattttgatgtacgtgggggtagtttggtagttaggcagatactcatctctttaacgtaaaattgtttgcctcccttgtgctgaagctgtttgcctcagggaatacttaggttggaaacttataagagaaatatctggccttttatagcctttttttttacagggctcccatccaagaaccacctggaaccactgatttacttgaaaaacattcagtattattagctacagtctaaagaaaaagaaaaacagaaagatccccaaaggggcaaattccagagaccctaactcagatggaaggctgccattgtttatttaccaaaaaagtttgttaagcaaatgaatacagtcagaagcttaaacttcaggtatgtctcaaatttacatgtgtacataaatcacgtgagcatctgcttgttaaaaatgcagattctcattgcattttaacaaggttttttttttttaagttgtgtttggggtaggacccaagaatttgcctaacaaggttccaggtgcgactgctgctgctggtcgtggaccacactttgcgcagcaaggtcttctcatgattcatttgtttgtaaacagcaccaaaaaaaaaaaaaaaaaaaaaaaaaagcctcggtgactcacaagagcaggccaggccagttgacatgaatagcagtactttatttaccaaaaccggttacattagtgcaagtaactgctttaattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttctaaagagtgagtgggagagagcagttcacattgaggtttcctacctatcagtgttctcctccttttcactggggaaaacacataattctatattactgtttcactaagacttcctacatccaactgtgcatttggacacaccgatacaccaacgttctcatactcattcacacacacaaccatgggaatttagcaaattgaattagaaatgagaagaatagcatgtagaaaaggagagtccttcaacagaaagccaccaaaagaggtcatatagtacaatcccttgcctcccagttagcaggacagagccttaactcgtgagattggctgcaagtgttgctttgtctttgcagtccaaagtagcactacccaattgaactggaatatgagccacatattttttttgagacagggtctcactctgttgcccaggctggagtgcagtggcgtgatctcggctcactgccacctccgcctccctgtgttgggattacaggcatgagccactacccctggcctccattgacttttatattaacattttctccctccttacctccctttcttcccccattccccagaactaaaaatcataactttgtctatcagaggacttctttaattttttatcttatttagatgaagattatttataattttaaaacattccattagctaagcatttaatattacttttgtggaaagttacatgaaagtgggactcccctagagaattgatgatatatcatcactgtaaatagagatgatgctctcgttccactgtgccaagccctgatccatatgctcatgacctaaatggcaggagagaggattagttgtgttcaggaaggatgtctagagttatcacttgctaattttcccctttatttatttttattttttaatactcttgtctttttctttttcttttttttttttttgagacagagtcttgctccatcacccaggctgaagtgcactggcatgatcttggctcattgcaacctctgcctcctgggttcaagccattcttgtgcctcagcctcatgagtagctgggattacaggtgtgcaccaccaggcccagctaatttttgtattttttttgggtagagatgtggtttcctcatgttggccaagctggtcttgaactcctgactttaagtgatctccctgcctcagcctcccaaggtgctgggattatagacgtgagccaccacgcctggccttgtttgattattattattattgcttatatctgtaatgtataagtaagtgccccaggtagatactcatgtccatggagggcaggtgaaggttccaacgaaggccagggaatgaagggattgtcaccatgggcctagttgtgactgtgatggtcaggacatattggttttaaaatgtggtgatgataataacagtagcagttagctttcactgaggtttaactagctgtctggtattcttttaagtgctttcagtgtgtgaactcacttatcctcacaatgaccctgttactgctgttagtgccctcattttccagatgaggaaacaggctcagagagttgaagtaaattctctggagtcatatagcttgaaaatggcttaggtagggttcaagcccagacaatctacatggaaaccagtgttccattcccttgcttatctctgaaggcacttgaatctttgccagttttacgaatatgaggagaccagaaccttcttagtggcttatcttataattacccttgttagcaaattattctaatattaagatcctaaaagggcatacatttcatattttttaacatttcagaggtaggaaacagttggaataggtttggcttccagtatttcaaaattttaaatataaatatagtggaaacctaattcatatccaaccagttgacatcacatttttgtattcatataattctcaggagaaagacggaaatgataagaagcaagctactattgatttaatctaagaataaccttgcaggtatatctttggctcagtctacacactgagctcaatttctcgtattttgtacatacgtcattctaaggagtgatccctgatgtttgcagtggtaacccaaaggctctgtaagatttattatcaaagtttaaaaaaaaatgtttaccattctctactaaggcggaaatgtgaatatatacatcaaagaaattttttttctattgtgttgatgggaaaaaaggccttgttgctgtaactctagtttctagaaaattcagtaaagctgaagttcccatgtgaacattttggctgggctaagttcttctgtataaaccatgtcttggtttgtttcattgtagacactatgtccccaaactgcttatctttattcatatatctcatctctgccagtaggtattttttgctgctccctcaaattttctgcatttttcttatagagtaaaccctgctaaagcaaataattattttgacacttgttaaaatagtaatgaagactattcaggactattgcaagaggtgtcaagtctattgcaacaggggagaaagattaggcccaactctaaatacagcaaagatagctggagatttatagccagtgaggagaatgagggggtcagtggatggaaaattatgaagaggagacatcacgagcagggaaattcttgttaaaccaacttgacaggattcttgtggaaggcaggccaaggtgatcaggatggggattctttctaaagtgacttagcaggattcttgctacaactggactagacaggcttgtcgaggacaggatgggggtgggaggctgggaggagggtaagggcaagacgtacttgagaagagggctcagaggagcctgactaaactttggtcaaggagagagtctttgtcagctctcagatcaaagctaaagtcactgatctcctgtcatatattaaaacattctatatgcagaaggttaatctagttaaagcagagcaaatctattacacttcagattcagattttattaagtgaagaactaaaacttgactccctatgtagaacaattcactaatttctcctgcactctagcagctattctatttctctttaaagacattgttcatgtccccaagtaatgccatggatgccctaaaatatcttccattttttctgagctgctctctgcctgagcaattccagtagtaattcttatcctaagaaaagaattctcctcccaccccatactgctacatctggtgttgaagacttaaatacccacgtgggtccaattgcagtggcggagtttgaacttgcaacctcaatacactagaagttcacctcattagtgagctaagataattgaattgatgtactgccattaatattctttaagttctccaattccctcgctcactgtttctctcagtggttgagtaaatgagatgtaactataacgttgatggcagaagtcacatgaaactcagtgtcatgcattatagcattgcccttatactgaggagtttttcgttccttgcaaattcagctgctcacaaaggttgttctcagtaaagccactgtacagataaagacaatggtcccttcatcacaaattgtgaaagaaaggatattctctttggctactaaatgcccgtttctgtttgtctagtaagtggtgttggttattattatcaagatcactttccagagaaactttgctgaagacctgtccaaattaaggcaaaccatgatgatttggttttttaagggctttttaatatatttataaaatattgacctaatatagaaattacatctgattttctgcaaagttgcattgatagctcatagcccagctctgctcttaccaacatgggcaaatcagttaacttctttgagcttgttttcctgttataaatgatgcaagagtttctgttgctttggtaatgctgtgtaacaatcaatcacaaagcctcactggcatttgacaataagcagttactgctgatgcatctggagtcagtggtgggcccccatgcagctctgttgattttggccaggctggcttgaatttctgggggttggctgatcaaggttggctttggcagaggtgattggaatgactcggctctgcttcatgtgtcctgcttccttcagccggctagcctgtgcatgttctcatggtgatggcagaagttcaagcaagcaagtagaaacatgtgaggtctcctgagacctaggctcaggacaggcataatgtaatatctgcattttgttggccaaagcaagtcacaaggccggtccagatttacagactagggagatagggtctgcatttttttttttttttttttttttgagacaaggtctggctctgtcccccaggctggagtgcagtggtgcgatctcggctcactgcagcctctgcctcccaggctcaagccatcttcccactttagcctgcgagtagctgggactacaggtgtgcgccatgatgcccggctaatttttgtattttttgtagagatggggctttggcgtgttgtccaggctggtcttggactcgtgagcttaagcgatctgcccgccttggcttcccaaagtgttaggattacaggtgtgagccacctgtaactctgcatttttaatgagaggatctgcaaagtcacacagtaaggggtgtggataaatgaaggagtatggcattaaagctgtcagtgctgtgtatcacaaatagggataaaagtatacctccttctttcatttgaggtgagagttaaatgatataatctatgtagaaggcctagcataatacctggtacacaaaaagtgctcagtgaatgtcatctactcttattgctaatattgccatgcctaatgttaataattaagatagaatttataatatcaacttcctggcacagctgtggcaacttctgcatttagattgcctctttttaatttatcatagagtgagggaggtgcctggggggttttgctgtcgctactcctccatacatgcctagtatagtagctttcattggaataaagatccttttcatgttagtgccctggccacattccagaacccaccctatcatttaacgccaagtctggctcatacaagagtctcatgaaattactcatgaaattactcgaggagccaaatataatttctttttcttttttttttttttttgagaccaagtctcgccctgttgcccaggctggagtgcagtggtgcgatcttggctcactgcaagctctgcctcccgggttcacgccattttcccgcctcagcctcccaagtagctgggaccacaggtgcatgccacctcgcctggctaattttttgtatttttagtagagatggggtttcactgtgttagccaggatggtctcgatctcctgacctcgtgatctgccctcctcagcgtcccaaagtgctgggattacaggcatgagccaccatgcccggccatgtaatttctagaataggtccagatttcataaccctctgcaggctaaatcttgttacaacaaatatcatccggtcccaatcgtgacagctcatttatgcaatcttcggtcaagtaacatccagcaaaacaagtaatttagatagctcattgggaattcttttgaaataagtatgaacacttactcttgtccttgtctttgagtgtgctgccacgacgatgacacattggctcacctttcttgtttgttttctccatttctggctagcattgggcagtgttgcctttgccacatattatcagccacagtcttgtcaagcagatctggtcagacctatggaatgtgaagaccctttattagaaattcatttacctaaagaaaacatttatgccttccaacagatctgaatgttggaagtgaccagacatagttacttgctggggagaatttacccacagccaaaggctagactatttgagactgattgacttgtaaatattattctggtttctgatccatcctctcttaaagttggaaagtggaaaacaggaaaagatgagttataaaattagaacacagcctatatgttcatatccagcaaatagaaatataaatatctacctgagtcttatgaatatatacctttagataaaaggacatgagaaactcctcctgtaccaccagaataacccactttatagcaccaaataatttgattttttcttcttttgccaaaatgtttaatagctatgtaacactgctaatcctgacaaactgatatgatttattcactcacttggctgccagaaacctcagcattttctaactatccttagttcttctggtttaaccacatgtcccacttcaatataggtcactttttacttattttgttgccattattttttatcaggagccaatccaagggcatttttataaatagttatagtataagtaattaattaatgaatatttcatatttattggtgcattcatttatttaatgtctgtgtttctagtaaagtgacaattgccagaaagaaaattttaagagtccccctgagattaaagcctatttcttcagggttatccacataaattattaacaacgatttccatttttcacattccaccaatcagtggttacaactcaagaaaacttgccctgttctagagcaatgagaagactggaaacattttaatctcatggtttttttccagatattataacttctaagtatgttaaagaggaaagcctactcaacattatgccttttcgttaagaattttattaacattaaattagtttaaggttaatgcccataatcaaccttactgattttttttctttttcctttcttttctttttcagaactcctagcctataattattcctactagatatgtactatatttttaaaccattccaagctgtttgtcatgtaccatgttgacatcacctatcttagaatggactaggctaacttacagagtcacttgatttccactaaagtttgtgtttggtagtaggctacagtcattctggagacatttgctgtgaaccttgtcccctaatataacgatggattttctattcactgataagttctactcatggattcaggctttgaattactaaatcagagtaggtctctcttttcaaaaatgacttcacctaaaaagggtaccatgcattttttttttccctttttcagctttcatgttgttaaatctcatgatcatatctgcacagcaccatattttctatgagtgagtttgttaatattttctctttatactattggaataactgttatctgttagcatatatgaaagatatttgattcaatttcaactctgctaggtgccaattgaaggtttcaaaaagcataaattgatcagcttgtatttactgagcatctgctatattttagtattaggtatgaatgtgagatatggactcgtgaaaaatcatatcacatgagatatgaaatcataaaactaacaaaattttaaattagcagaatacttttttgtttgcttacatattcatgatctcatttgatctaaatcatggttcctgttctcaaagcttatgggtcttgttagggagaccaaataaatataaatgaaaagacaacaattaaacacacacctatgtattattctgattttaagcctcacaggaactcagagagggaattgaaagtgtgggtttaagtgtttgggattcatgggtatgagataggatttgagttgccttgtgggatttctttattatcagggacaaagctttgaagaaaactacaaccgatcatggggcaaactaatccctccttaaagcaatgttggcatatgtcccttcaaatgtattaatagaaccatcatgactcatttatgcaaagtacagaattcttatgtctatgtgatgggaggaagggtaaggagagggcaagaggagcaggagagataatttataatttgctaagataggagcatctcattaaagtaaagccctggattgaagggtaacaagtgcctatgcatatgtgactcaccaatgtctggtgtctgatgtagaactctatgggcaaaatcctggggtgcaaagaatgaaaaaggaagaacctatttttagataacactggttgaggaagagaactaagaactgcccatagatcaaccaaatgaactgtatttttatagtgtggatccataaaatctgaaatagttgtttttttttttttttttttttttttgagacagagtcttgctctgtcacccaggctcgagtgcagtggggtgatctcagctcactgcaccctccacctcccgggttcaagcgattcttgtgcctcagcctctcgagtagctgagattacagttgcccgccaccatgcctggctaatttttgtatttttagtagagacagggtttcaccatgttggccaggctggtcttgagctcctgacctcaggtgattcgcccacctcggcctcccaaagtgctgggattacaggtgggagccattgcgccctgcccctgaaataaatagatatttaacaaaacgttgctttgcctagagggctcttaccctgaatatggcagattttaccaaaataacacttgagttaatttttatatgttatattttgacctttgactggctctaaataaatatttcctatggataacttcaccttaagacttccactttaagggatttctattaatgttatatgctgcctggttgaggtgtgaggtccaagtttggtgaagaaatactatttctctatttttttcttattttaaaattacagcaggtttttgacttgactgaaggcaatgttattatgtgatgctgtagagtagtctaaagataaaaatcagaagtgttcagtgatttatcttcctagttccagcatgctaaaataattatttctcttatttgcattgacatgtcaaccaatgaaattaatcaccttcaaagattttccttgttcttgaagtctgctggggtagttcaacaccatttcacagaaaatgttatacaataaatctgtaaagtctgccaaaaaaaaaaaaattgagaacctgaggtgggggatggtgtggggagtggaggtgccagagaagacaagggcaaagagcagctgaggctcatgggaaaaaaaaagtgatttacccgcgttttgacaaatgtgagagggccacaaagagtgagttaccgaagtgtggattcagggaagacagaggtggtgggggcaggggaggaggtggaagaaaaggcagaggagggaggaactggcatgtgaataaactatttgtcatttttcactctggcagtgggctgaaatgtttttgcctctttttattttcatttagaatgccaatcaatgggttacagacaaagagctttgaaaaccttttcttatttatttatttagagacggaatcttgctctgtcgcccaggctggagtgctgtggcgcgatcttggctcactgcaacctccgcctcgcgggttcaagcaattatcctgtctcagcctcccaagttgctgaggttacaggcatgtgccaccacacctggctaatttctttttttgtatctagtagagacggggtttcaccatgttggtcaggctggtcttgaactccagacctcaggtgatccaaccgcctcagcctcccaaagtgctgggattacaggcgtgagccactgcacccgccctgaaaaccttttcaaaatgcattaaattttaatgaatttgatagccattttaatgcctgggagatgctggacagggagggtcctatgaaaccaagctgcttagagagaagtatctggaaacactcagccccattttaataatagccacatactccataaaaatacctcaaagagaacaggagcaaaatgaccttaagattcatcataggaatccaaaaattccaaaatttgctgaagatctttttagcttggagagtgcttatttttttgataatttattttaaaacctaataaaatgttttgcttttgtacaccttgtcccaaataaatattttctttggacatattcaactttttattatttattgggtgctttctattattgctacatcctggccagggtattgagagggaaccttttattgtcctctttgtccctatctgtaaatatagtaatccccccttatctgagacagatactttccaagaccccccccaacccccgcccagtggatgagactggggatagtactaaactctatatatactatgtttttcctatgcatatataactatcataaggtttattttataaagtaggcacagtaagagattaacaccaataactaataataaaatagaacagttataatgatatactgtaataaaagttatgtgaatgtggtctctctttctctcaaagtatcttatggtattgaactcatgcatgtacttcctatgatctgtctgataaccaagatagctagcaagtgactattgggtgcgtatatacagggtggagatgctggacaaacgaagggtgattcacatcccgggccagacaggctgggatggcatgaaacttcatcacactaatcagaatggtgtgcaatttaaaatttgtgaattgtttatttctggaattttccatttaatattttcagaacacagttgcccataggtaactgaaactatggaaagcaaaatcgtgaataagggggtactactgtacttctcttcctagtaatatgttcatgctgccaggatgcacatagccatgtgcgaagaaatataattttttagataaacctccctttaagcagaaggtctcaatcctatttcatggagaaaagacccacgtttatactaggactctctcaaccttctacatctaatctttagattcttctgcatgcctgcctatcattttaatcttctctcctctcataagtctgtctcatatctaaggtgaatccttccatatagtctctggatcccatcacctcctttgccctctgagacaccactcatggcttgctttgtcccatattttcagtctcttccttttcgctggatcctttctattggtatttaaacatagtcaaatctctcagcttttcaacaacaacaaaaacagtaggaacagcattagcaagcatatgcatgaaacccaaactccaaaccctcagacccttcccttaaccctacctctacttctctcctatctttgctttttctccttcatagacaaactcaattaatttgtccagacttgctgtcttcgcttcccacacactcttcatcccactagtttggcttctgtccccatccctctttttcttccaattttctcagtcttattgaatgacggtgtttgccaatatctttctgaagcctaggaatgaatctgactctctctacgttcctcactttcccacataaaatgagtcacctgtttccattggtttggtctctaaatctctcctttgagtccacccacttctttccctccccattgcccctccctaatttgggaagatataatttctttttctctgtgaacgtgatgggccagccaatgcatgttgctacatgatgagtccctaaagacttagggccaggtgtggtggctcacgcctgtaatcccagcactttgggagactgaggcgggtggatcacctgagctcggaggttcgagactagcctgggcaatatggtgaaagcccgtctctactaaaaatacacaaaaattagctgggcatggtggtgcatgtctgtgatcccagctacttaggaggctgaggcagaagaatcgcttgaacctgggaggtggaggttacagtgagcagtgagccaagatcatgccactgcactccagcctgggcgacacagtcagactcattctcaaaaaaaaaaaaaaaaaaaaaaaacttaggcatgctgataggcaaaagatctagtccccggagatttccttgtcattttaacatcctcctgatgtgggttttctgtttgaaattgtgacttatgcatctctcagttgattccctttcactccctggcatttctctctgattttgggagggatcctctgttgttactagaggctctgagctctccactgttattttagctctttggtcaggtcctggctctggtcctcattagctgtgtcagcttgagcagatcatagactccttgacccttaatttccttatctgtcaaataaatggtttcccctggtctagtgggtctcagccctgactgcacattagaattacctggggaactttttaaaccctcccaatgcccaggctggacctcagaacaatgatactagcatcccgatgcccacgacgcaggattttttattttatttagaaattttttgtcagtattattttttttttcttttgagactgagtctcgctctgtcacccagactggagtgcagtggtgtaatctcagctcactgtgacctctgcctcccgagttccagtgattctcctgcctcagcctcctgagtagctgggattacaggcgcctgctactacacccagctaattttttgtatttttagtagagacggggtttcaccatgttggccaggctggtctcgaactcctgacctcaagtaatctgcccgcctcagcctcccaaagtgctgggattacaggtatgagcccctgcggccagctctcagtattttttaaagttcctccaaagattctaatgggcagacaaagttaagaaccaccgacttaatgatttttaaaggaccttttgctctttgctcttctagcagtttgtgttttatcccaagttgaagtttctcttcttttaatgtttttaccaagttgggaagaaatagctgtgaagctcccccgacccccttccatctgctgtttgttcttatttacatatgatggaacccagcccactgatttatagctctggttccctcacaactgttattgaactgaaaacatagctgaaaacttattaaacagaaaaaacttattttgagcttcatgctgacaatttattatagaaccaaggaaacatttcaacgtctttccttctagagttaatgttaacaattgatttacaaccccatgctctcaaatgaaaaagttcattctggggccaaacccagtgttttttttttcttgggtgtcccattgagaaagccaaagcatctctgcaggagaactggatttcgaggggtttgtatccatgaacaggcagggcctcctcacattgctgccggtggcctctaatgtgacgtgtcagtagcccctttcctccagtcctctcttctggtccacagacaccggcagcaaagccaggcacgtacatcctcactatgggtgtggcctcactgttcaaatgctttgcgataggtctttcagaagtccacctttcggtagcagccccctttagacctaccattttattttattattatttttttagagacaaggtctcactctgtcacccaggctgaagtatagtggtacagtcatagcttactgcagcctcaaactcctgagctcaagtgatcttcctgcctcagcctcctgagtacctaggactacaggtgcaggcgccaccatgcctggcctttaaaaaataattttgtttttatagagatgaggtcctcttgtgttgcccaggctggtctcgaactcctggcctcaagcaatcctcctgcttcggccttccaaagtcctgagattataggggtgagccactgcccctggcctatacctacccttttaaattggaaataacaagacttttctgagctgccaaggagtagagaggagagtaggaagatgatatagaagagccgaacatttagtttaacccacggaactaaatctggaaagaactggggtcctgacataagtgtgattcatattggtgaagtgtcctttggggtgctaagtctccctgcccgtttctctgtgttaacagttatctctttcaactgttcactttcttctgcaatacctatctgaaatgcacagcccatgcctttcctgtctctctcagtcctttattaaatgattaaaattagttggcaccttgataaggatgaactagtttagtagctacagacaggtaagttattggtttgtcataatctatggtgaattcctatccctgtatacccgtataattcattttatagctgggccaccacattattctcatggaaagaaatggttttttttttttaatgttttttattttttggagacagggtcttgctttgttgcccaggctggagtacagtggtgcagtcatggctcactgcaacctccacctcttgggctcaagcaatcctctcacttcagcctcctgagtagctgggactaaggcatttgcctctacaccaagctaatttttatattttttgtagagatggggttttgccatgttgcccatgttggtcttgaactcctgggctcaagggatctgctcatctcagcctcccaaagtcctgggattacaggcatgagccaccatgcccagctaatttttatatttttggtagagatggggtttcaccatgttgtccgcgctggtctcaaactcctgggctcaagtgatccacctgccttggcctcccaaattgttgggattacaggcatgagccaccatgctgggcctggttagttatcttttagtggtggaaaaaagggaattttcctggaaaaagaagtgttgccagagcatggagtcaagctgaaagaaccccttacttaccatgttgagtaaagagtcatttctcatgcaagccaattttgttccagaaaacctcgactgaagcttcttggctttgacgttccctctttgggtattttcttgtagatggaggaattggttgagggcgttcgctgggcctttattgacatgctagagaaagaaaatgagtggatggatgcaggaacgaaaaggaaagccaaagaaaaggtaaggattccttttgatgaaaaaaaaataagacttctggtttaatggatgttcatgcttgacattgactgtgtagttggtttttatattgactgaactgttgactctgaatgaccccagagttagctgtctgcttttggatgaatacatagatttttgtttcaccaggaggtaagagaaaataatacctgaatttttcgaactgcattttcaaataccttgtaattcggcctttcctttctcctaattgctgtctgtaagaggcacatggcttgctgcctggtgaattgtgtcataaaccatcactggatatggcagaatgcagagcagtggggagtcacagggagcagctggaacaagagcccctaagacaccaaaacgaagaaaacccatattggccacatgtccttctgctctgtgcatgatgcatgcaaatgtcctggggcaaatcctttcctgtaaccaagcatatctccttcccgacccatcatttggcacaaatgacccaaatagtatactgataaactgcagaccagtgttctaccattgcttaggactacaaacgtatttcctaatagaagtggacacttgctgggccttgtaaaattttctgatactatgcgacacgataagggaacaaaggagaaaagtattgacagccatgctgtttaaaagtagaaaacgggctgggtgcagtggctcacgcctgtaataccaggactttgggaggctgaggcaggtggatcacttgaggtcaggagtttgagatcagcctggccaacatggcaaaaccccatctctgctaaaaatacaaaaaaattagtcgggtgtggtggcatgcatctgtagtcccagctactcgggaggctgaggcaggagaatcgcttgagcctgggaggcggaggttgcagtgagttgagatcgtgccactgcactccagcctgggtgacagagcgagactccatctctgaataaatgaatgaatgaatgggatccattttgaattccagagattctgatagagctggaattcaagtgggtggagcatacctgctagactcttgatggatgcttctctgcagctgagcatttcttgtatctagaggtatttttgaaagcttcctgagtataacaatcacctgggttgcctggacgctctggctttctgggccccttcccagcaaggcctgggttaatggatcatggatgcaggctgaacagctgtcactttagccagtctccgggtgattgttatcactaggcaggtctggggaaacactgcctggagtcatactgagtcatactgagcacaaatatttttgcctcagcgttctgggaatgcttaaccttgttgaaatgagaacacgtagagttttagcaaggatattttctagtgctttaaactcatggtactggagatggataaacattgccatagatacttttgtcagtagatgtgaaaaggcgtttgttcagtgtttataatgaaggaagaactgggatggtgggtggcaaggcagcgttggaggaagacaaagagtaggtttgattttttgtttccccttcaaaaatctgtcaaagctgtcctcagtcacataaggcacaggctgatgaaggcaagagcacatgggctgtgatgggaaactctccagatggtagacaactttcaacaccaacatattgttgttttatgaaggcttcatttatttgctgagctagcttgtggtatgtggaacaggatgtgtcttgccctgggcagttgagcgcttagtgtattaagggctctttatcctcgcctgaccccacatgaaccgaagaggtgcttgcatgaattagtacaggaccaccagggtggagggtggggtggagtgtgtgtgtatgtataggtgttgggggtaatgtgttatgaatagctggatgccaggggaatgttctgggaagtgcagtcagttctttgagcagtgtggattgcagttgcctcagggagctcttctgagtggcataagggagtgggtgcctcacagttggcccttctcggcaagtggcccatgggtccttcttgaagcaggactattctcagttcttctaatattagacatgttcctgtttgcctcccgagttgctctccagtcttctattttatttcaatgagagctgtcagtttttcttctaaaagcgttctttgaacactctgctttctttgagctgagttcaacctgccaggaactctgctagttccacgacaggtacaaatatcaaaggcaaattggatctcacaaagttccccgactgtatcttgcatttcagagttcagagaagtttctttaacgaaatgcaagaaagatggatgttgttgaagcaatttcagcagttctttgaagtgggtcctttcctggaccccagaagatgtaaattttttttttttttttcccctcaaaattaaatgaacatgcagttcttaaaatgacctctgggtggagctcgtggtactcacaaagaacactagcggcgttgaaagcttttatgcagctttctactccggcgttgtttttgaaaaaaaaaaaatttcttgccctttttctctgctgtcctcgatttgattgccttttaatagtcaacaagaaaggagagactttgcctaataattccttgaatcttagatggaaatctcccactatcttagggttttgtctttctgatactgagtagcccctgcattaagaaaggatttgcctgcatttgaagtggaggtgaataactcgcctgctcttcctggtatgacttggcactgttctttgggcatgtgttgtatgcagtgtatcacccaggcggaagatttctcatcaataatagtgcccacactgggccaatgctgagtcacttggcaacccattgggaaagctggaaaaatgttctgatttgtgaaagggagaagcttttctttccctcaccatgaagctctggaccgcagctaattacagagcctcctaagaagtgttaacctcagcattccatagtgaccgacctcctgaaccgggcaggtacagaaagctgcagtgttctgaggcctaataccttggcttttgtagcaatgacctcgtctcaaaatggaagtgtgtggatgtggctttgttgtactctttgctaggggtgttcactgtaaaagataaatgaggatgcctctgctcccgtgaagggtaaatttgttttctctgtctccctgccttttcctgctcatctcttaagaggtcacgagtagtttttgtattgtgaaactgatggtgtaggtttcaagtggaaatttagtatcgtgaaataagcaccgctttttgtttaggattctctgttccctgcaagcatgtgctcttattgtaaataagcagcaaaggacagggcatctgttatttttctggtgaccacagctgttgaatgagtgtcaggtgataaaataatgattttaggggtgtcttctggaggatttgcccttgccagagtagaagaggaggatctcaaggtcgctacatcaggattctgactgagacctggcaggagagcgtcagatcaggaggagcaacttcctgagcttggcttatctccagctggatttgactatatagccaaaaagctggatcccttcggaattatttgtttgtttgtgctctttgcccctgggacctaagtttgtcaggtcacatccaaagaaaaatagcaggatgggactcacagggaggtggcatcctaatgatgctctgagggagtggccttaaccttggccacagcaggtgcagagaagtcggctgaatggtcctaaatttattggcatgtgactctcacacacaggctttgagtgaggtggtgagagttttcttgcagagggcgaaacagaggtgtagcccacttctttggctttgtctctaagctctaccaggcctaggtactggacttctcccaggtatgcggtcagggctctgcttatatccggagcctggtggttctcaaggtgtggttccagaccagtagcagcagtggtccctgggaactcattagagatgcaaattttcacatccccacctgctgagctctgggagtagggctcagtgccttgtgttttacctggtgattctgctgcgtgaaaagggttgggaacccctgtcttgtccttaccacttcacagcacacctgcctgacttccaactgcagcctcctgcattttggccaagagcattctctccctgctacagcctgctttgctactcataaagagggcccaaaggacggggaatgaccacaccttcctcagaagtcctcacccaacagttgatgggagttgctgtgtgtggcccccgctccctcatccctctagtgcgtgttccacatgggctctgggagcttttccaatgggctagagctattatactagctaagatactcgttgctgactgcctttctttctctacatatttcctctttctcctaccagtgtttcttttgctgcccaaatgaactgctcgcacttgaatccttgtcttagagtctgtttctgggggattcccaactaggacacagcccctgggggtatacgctttcccagtgcttccttgcctgtaaggcaacagcacatttcaccgagtctggttgctagcactgcttcagcagactcaatgccacaaacatttctagcacaccaacagcatgccaggtgctgagccgggattcggactcagagatgagcagccacagtcccttttctgcgggggccttcaggctcctaggagagaacaggaggccatggatgcagggcagaccaggagaagtgttaggtaacgtgatggagacgaaaggggtcctgggagtctaggggagctcaaacatgacatgtgagggtgccttacttgggaagtgcctactctgcccctttctctcttcctctgtggtgttcccacaccctgtcttgcagccttgtggcaagtcttcctcttccttccttactaatcccaactctgcatctggctgtcacttccccttgataccttcactcctgcttcacctcactgtgcattttaaattgtttcgtaggagaaaagaaacagaagggctttcatcaaactgtctcctgccctttccagttacagattctagcacatttgcataaccgctcaagaatgcagtcaccctgcgtctggcatccactccagggctcaccagggacagtgactggtagaccagcatggaaaccgcgggctgtggctccctcccatgtgccaccttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccaccctcagttttcacatccataaactggggagattggtccctgtctcagaagatttgttatgaggattaaaagagccactgtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtattgtcgttgtgatatatattttaaacacaaaagtaaatatctggtataagtgggagtttgatgcatatatctatttattttttcgagttaaagtctcgctctgttgcccaggctggagtgcagtgttacaatcatagctcactgcagcctgaaactcctgggctcaagcgatccacccaccttagcctcctgagtatctggaactataggtgtgtgcccccacccaccttagccttctgagtacctggaactataggtgtgtgcccccacatccagctaagtggttttcttaatttttttttttttttttggtagagatgggatctcactgtgttgcccaggctggtctcaaactcttggcctcaaccgatccgccagctacagcctcccaaaatgctgggattacagtgtgagccactgccacacccagccaacatatatttattaaaggcatagtacatgtgatatcttaccggagtgattttccatgctctagagcctcatgtaaatgtcatttagggggatgctttaggtcattcattctcacacttgagcatgcatcagtgccatctgaagggcttgttaaaacaccaattgccagccccacccctagaatttctgattcagtagtgctaaggtggagcctggatatttgcatttctgacaagttctcaggcaattctgatgctgctggtctggggcctgtgctttgagagctctaggtgattacaagtgaaaatgtccttatgccaagcctgtgttaatagaagggtataatgttcattaagtgattgtcttacctcttactggagtccccttttcaccatttctcgcaggtgggtcccctgagtgagtactaggacacccagaacccagccaggccacctactctactgttgctgtctctgctaaagagccctgcttgagagagatccaaaggctctttcttggtcatttctgctccttgactccacatctgtccccaggaactacccaggttaagtcttccacataaaagcccttccaacgtttgaagatgtttaaatgtttttcttttttctttattttattttatttatttatttttttcgagacagagtcttgctctgtggcccagactagagtgcagtggtgcaatcttggctcactgcaacccctgcctcccgggttcaagtgattctcctgtctcagcctcccgagtagctgggaccacaggcatgcgccaccatgcccggctaatttttgtatttttagtagagatggggttttgctatgttggccgggctggtcttgagttcctgacctcaagtgatccgcctgcctcagcctcccaaagtgctgggattacaggcatgagccaccgtgcctggctgttttttctatttcaaataaaacacctttagtgtttctcacattaaattaaccaacattacagtcagactggatgttctaaatgcttcacaaatattagctctctcaatgccataatatccgtatgaggtaggtactttttttttttttttaatacagatgaggaaactgaagcacagagagtgtgagcacacttacccaaggtcacacagctagtaggtagaagagctgggattccctccctagaggtctggtttcacagtctgtgcttttatccgcaatgccagtgggtctcaaagtgtggtccccagtccagaagcatcgccatcactcaggactagctaaaaatgcagattcttggctctatcccacatctatagaatcagcaactctgggagaggccctaggcatctgtactttaatcagtcctgctggtgattctgatgcagcccaagtatgagaaccattgctctaaggtgtggttctgatgcctcatcctgctggctgctctccagttttcaatatcttttttagaagcttaagttcaaggctgtgcacaatattctaggtatagtgtaactcacacagcacaatgggaatattattactgcctttgtcttgcatacaaattatattaagaaatccaaagtttacattatggctatcttttcccctcagccattcactgttggctcataacgaatttctagtcagttaatttctaggtctttttttccccgctcacaggaactgttgttaagccctgttgctccagtcctaaacttggcattaaaaaacaaacaaaaaaaaaaaccctcatcccagaacttcacatttattcttattaaaatccatttagttgttttggttcatggctctggctttcaaaaagtatatttctggacctcctacatgtttattattgttttaaaaatctatgctcatttaaaaaatctggaaaataaagcacaacagtagaaagacaaaaaaaagttctagttccatcatctaaacataactgctgctaacattttgatgtatcactttgacttttttcccatacataggctttgaaaggcattcttgaacaatgatgtttataaaaatttgagttcttttttctcttaacatttattataagcatttcttgtattattgcatattctttatgcaagaatattcactgttggctgggcacagtggcccacacttgtaatcccagcactttgggaggccgaggcgggtggatcgctagaggtcaggagtttgagaccagcctggccaacatggtgaaaccctgtctctactaaaaatacaaaaaattagccgggtgtggtggcaggcgcctgtaatcccagctacttgggaggctgaagcaggagaatcgcttgaacccggaaggcggaggttgcagtgagccaagattacgccgctgcactccagcctgggcgacagagtgagattctatctctcacacacacaaaaagaatattcactactatgacatattcttctagtggtggcacaggaggtactacttaaacatttctctatagttgcatgtttaggttgtgctgttatagttattactatgatacacatcttttgcataatgccttctccctaaatgtaggactaattccttagaatggcatctcagacaacctttgaaaaggtcaactctttccttcagtatatcaactactgtttctatgtcgttcataacttgataagtttgttttttagttttattattttggggttattatgaatggacatgctcaaaaaaagggaattggaatcagccaatttgttcatcctttggcaatgcccttccagatttatctattgaacaaaaatattcagggagaaacttctaagtggtgagtcttttgttaggtgccagtcaattcactaactaatagatttttggtctagttgttctactttggacaaactccatggaactatgatttaaattctcccttttgcctgcaaggagaccttgagatatttagcaatgcgttgatatcatccagttatactgtatttagggcattctttaatttaccaatgtattgttctgtttaaaatgtggaaacctgaggaaatgaacaaagcttcactgggttctcatttttctgaagttccatgttacctaagtgcagattatatcattctgtgaaaacagccagctgttcaggcaaccaaatcagaaatctcagtctttcctcttagccaacttgtaagcacaaatcgtgttgcttctttctgccagctctcaaatttataccatttctgttttagttattcccctcccttagcttctcatccttaaacattttttttaattgaggtaaaattcacctaacataaaactaaccattttaaagtgaacaattctcaattagatagaagaaataagctctcatgctcaatagcagattatagtgactacagttagcaacagtatattgtatattccaaagcggctagaagaaaggacttgaaatgttaccaacacatagaaataatgaatattcacagtgatgggcactccaaataccctgacttgatcattacacattctatgcaggtaaaaactactcacatgtacccataaatatgtacaaatattatgcatcaataaaagaaaagaaatgaagtgagcaattcagtggcacttagaacattcacagtgttgtgtgatcaccacctctatccagttccaaaacatttttgtaactcccaaaggacactttgtacccattaagcagtcactctccattccccactcccccagctcctgacaactaccaatctgctttttgtttctatggattcatgtattttggatatttcctgtgaatgagatcacgcaccaatgcgatttttgtgactggcttctttcacttagccttatgttttcgagactcatccactttgtagcatgtatcttctcattctgtttaattggcgtccccattgatagtcttggaaaaggaatagcaaaataaacccctgtagcatttctgatagtgagatctttcctgtcttctctgaactttttgcaatagcatcgtagtgtttattcatagctgaaatactatcccccagctatatattactgaattgaagcaactcctgtagggaaagaagtatgtctgactactttatttttgtattttcagaacctaatgtggatctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcatttttttttcccaagtttcctctaactgcctccctcactaaataacatgctccattatagtgtcttaaaattgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccattttactataaatatttcattatgtatctccaacatataaggaattttaaaaacctaactataataccattaacatacttgacaatattaacattaattccttattagtatcctgtctgtgtgcagtttcctataattatctcaaaattgtttgctttcttttttttgaaaaaaaaaaaatggttgatttgaatcagtatccagatgaggtctgcatattgcagtcaataggtacatcttttaaagctttttaaattttaagagtaccgcctctccatccatgaaatttatttatgaaataaattgagtcatttgtctggtagaatttttaacaatcttgttttgctagttatttcttaatgttgtcttttaacatgttgttctgtctcttacattttctgtaattggttctatctagaggtttgattagattcaggttcaattttctttggataagaagacttcataggcagtgctgtgagcttcctgttgcatctatcaagaggctcacaatgccacgttgtcccacttgcaaagcgaagggcgatccgtgtgttcaggtgttgtcagcctgatcctttcatttgaactttcttaccattcctcatgcagcagtcctgtttcttggctgtacattagaatcacctgggaagctttttaaaaatcctgaggctcaggccacaccccatatgaagatcagactctctgggagtgggacacaggcattttctaaagttacccaggaggggcccggcgcagaggcttacgcctgtaaacgcatcactttgggaggccgaggtgggtagatcacttgaggtcaggagtttgagaccagaccagcctggccgacatggtgaaaccccatctttactaaaagtacaaaaattagccaggcatggtgtcatgcacgtgtaatcccagctacttgggaggctaagacaggagaattgctcgaatccaggaggtggaggttgcagtgagccaagatcatgccactgcactccagcctgggtgatagagcaagactctgtctcaaaaaaaaaaaaaaaaagttacccaggagatacaaatgtgcagccaggcttgaaaccactgacttaattgtttcagtggccattgataatatttcattgattcgtgattccattcggtgttgcaatgtttgattttcaaattctatcattctttttgcatttattagctaggctgtttttataaaaaaggattttccctcatcaaccacttgattactctgacatatagtttatacaggaaagacagcataaatggctatctttctcttgattaattttcacaagttggtgccctaagcacttccagaggtgccaaaatagttttctttttagtatcaccaacttagggaatcttatgtatttgatgtgtttaaatttgttatgatcatcattcactgaagctcagattgtcccatcttggccaatgtggggctcttcctttagtgaattttgacatgaccctagttgtttttgaaagcatctttgcctcctggcacaagatattctctttaatgtttaacctctatttaatcataagctgttttgaacaatttgtaaatcagtgcctaaattagttctcccaccaatgaacagtatattgatttttttctgatggggaaagggtagcaccttactaacttgaaatacagcattttattaatgagcaaatttgcagaaatatctgttagagactgatgtaaattatcttttgtaaggggcagtagcttatatcaatagaaacacacgtaatatgtactccatggtttttgaaaacctctgcagtgttgcattttcagtgttgatcatcaagaatacaaatatataaccatgtcatacattttaaaaacaaataatgctagtgttgaggaatataactaatttcaaatttgtggaacagtgggactatattaaaagatgagtctgggtgtggtggctcacatctgtaatctcagcactttaggaggctgaggcaggcggatcacttgaggccagaagtttgagaccagcctggccaacgtggcgaaatcccatctctactaaaaatacaaaaattagctggacgtgttggcacgcacctgtaatcccagctatttgggaggctgaggcaggagaatcgcttgaacccaggaggcagaggttgcagtgagccaagattgtgccactgcactccagcctgggcaagagagtgagactctgtctccaaaaaataaataaataaaataaaattaattaattaattaattaaaaaaataaaagacgaaacttggaatagtaaatacttaaaaattctaacaatatcaacaggtagtgatagtttaaacatgtactgtaaaagtgtttggtttttaagggtatgtaagagactggttgtctgtgggactttgaaagcagttgggaaatgccacaatagcctcagtataaaattctagagacccaaagcggagagagatgcctcttaagaattatggaggatatttattacttttattcatgggatgggtggtggtgatttaatgcctgtctcttgtttcttttgtttttttttgttatccaaatccaaatccaaattatatgaggaattcacttaaaaatatacgtttagtttggtttaataaaaataatcagttttgatgtattgacttttaatttcatgggggaaagagtccattaggaatgttcaggctttctgtgtatattttgtgttgctcattctctttggcccaagatgaaactaatagccacaatgtgtctgctttggtgctgtctctagggttgtgtctgctgctgtcagctgcacccttgttatctggctgctggtcctgctcagtcagttgtacaggaatgtcatttccattaataaccccagggccggacaggcagatagtggaaaatgggtgaagagagagaaattgtatttaacccagtgttctgagttgtcatttttgagaccctagcatagctgggtaaaggcaagcagagggcatgacagcaaatctatttctggcagaatctcatatacaaactggagaaacagcctgataccaagagaagaaagggtgaaatatactgggaaaagagggaaagatttggggttggaaaagtcagaggaaacaatgttaggaagaaataacatgatcaagtattctgatagaggtgctgacaactttgcaaaataaatttaattttgattgtaaatgccatcatttgtggtggttcaaatgaacaaaattcctttttaaaaaatgaaatttatgtaaggattgctcatagaagattttggagttttgtgctatgtttttttttttttggttctggatcagtgaaaggcccgaggaacagagtaggttttatttttttttccatctaggtagaatgactcagttactgtagttgtctgtgttttggttatttattgctgcataacaaattaccccaaaacttgctggcttaaaacaagtattttattatttcctatgattctgtgggttggctgggctcagctgggtggctcctctgctggtttcacctggagtcccttaggcagttgcagtcagatggtggctgtggctggacgtccaaggtggcttcttcacacatgtgtctggcacctcagtgttcctcatgtggctttctcaacagggtgctgtggtactcctacagggtagctaagagtgccaagaagagaaagcagaagctgccggtcctcttaatgtctgttctcagaagtctcagaatataattgacaaataataattgtatatatatttttggggtacagtgtgatgttttgatgtatgtatacattatagaaagattcaatcaaactacttaacatatccatcacttcacaaacttatttttttggtaagaacattaaaaatctattattttagcaattttgaaatatataataaattattattaactgtggccaccatgcagtacaattggttactaaaacttattcttccagtctaattgaaattttgtgccctttaatcaaaatctcccctttccctatctctccccctccctccagcctttggtaactactttctactctctgtttctatgagaacaactttttaagattccacatataagtgagattatacagtatttttctttctgtgttttgcttacttagcattttttttctatttttctgtttggttgattaggctatttttcattattgactgaattatttttttctgtttagctcaagaccattgtatacatcgactcacagaagtatttgagtaagcctaatcattgttgaactgtgatggggaaaggattcagccttgggacacgtgacctttgtgtacaggtgtaagaaattcctactaggttttagggcccagaactggactaggccatgagggacccaacccatcctagtaggcaaatcattttccagttttatatttgagttcattagtaaataagtttactttccattatagacaccccctccactgacttatggggtcctgtacgccataaccaaagactcagtgttggaaaggtgatgctccactctgtgtctttgtttagctaaggtgaaggggacaggtctgccaccctggtatattctggtattctctcattggcagtcttagtgaaggctcatgagagcttcctcacagaggtttgtaaggattagaactgagtggaatagacctgttccagggcagagtgaagccgaggacaacagtgagattgtgtccttcagggccacagaccagaacctttactcaactctgatgttaagctataaagctagtttacaagtttatggaacaattcagcttgttcttccaggctcttgaaaatgaaggttaaggctgggcccgtggctcatgcctgtaatcctgtaatcccagcactttgggaggccaaggcgggtggatcacttgaggtcaggagttcgagaccagcctggccaacatggcaaaaccctgtctctactaaaaatacaaaaattagccaggcgtggtggtgcctgcctgtaattccagctactcgggaggctgaggcaggagaatcgcttgaacctgggaggcggaggttgcagtgagccgagatcatgccattgcactccagcctgggcgacaagagcgagactccgtctcaaaaaagaaaatgaaggttaagttttggcaaagtgatttgtatagatctgtaatacatcatgttctaatgaggtccaatgagttctaagtaatttctgatttccattaaaaatgattcatgaaaaaataagaatctcatcagagagagagagagaccacttttgaaatgaggaaaaatgacagaatagaaaaggagaaagtctcttttctctcttcttccccaagcccccctcatcactggttacttatttgagcatcctttatcagcatctaatgagaatgagaacatagtgggatgccatgtgaccttttgagtaggaattggaagctcttatgaagtttccagcctgatgtcacttcagatccaggtcattaatatttaaaaaaataaaaaaaataaaaactcttaggtgattcgaatgagcagccaagtttgagaagcagagccctactggagcaatgcttctgcaacttgaatgtacatgcaaatctcctggggacttggttaaaaatgcagattcttaataagtttggaggggagcctgagagtctgcatttctaacaagctcccaatggaggccgatgctgctggacaatggcctatggaccatactttgagaatatagagcagggggcagcaaacttttcacatatgaaggcctgagagtaaatatattgggctttgcaggtcatgtggtctctgttgcagcaacccaaatatacctgtagtacagagcagcaataggcaataggcaaacaaatgggtgtggctgcgtgccaataaaactttatttacaacaccaggcagtatcctgaatttgtcttacaggccgtgagccaataaaactttatttataacaccaggcagtatcctgaatttattttacaggctgtgacttgccaacttggtctagagctttccctgtctcaagtttttgagccgtatcttgcttcttccctgttttgttgggctgaatcttaggtaagaattaaatggttttgaaagaggttactcaatggctttgttgaactgatgaataattgatgatgacatttaggctctgtttacaaacagccccaattgtcccttggttgtggctcattgctttgccttgaatataggtggcctttctgatttctctccctagactgcctcttcagcaatggatcgaaacagagctagggtttattctaaaatgtggcccacgggcatctcagaataaataaccaggtctgaactgtagaggcagagggtggcttcaggtcacttttccttgacctgcattttacaactcatctctggtgttttgtctaaggcgacagaggctggtattttggctatctgagaggtagagagcagagaggttcctggacatgtacattttgtgttgagataggtcatgccccagatatggctattaatggtagcagagagttaaatgttgctgataatatattctaataagtagataatacagaaccaagttgtcagagttttggggggacccaaatttggaaccaaggactcaaagctcagaagggttccatcttgtgggcttcaggagtaaggtgcaagattcctggtctgctgctcatggtaaatttcctgcatttcaaaccccaaagtcagttaggcctaagcttcaggaaagttttcagtttaattggttcaaaactgaaacagactctcatctatctttatgacagtgctaggattcctaagggagaggtgttactcctcttctgaaatgggaggatgtgggccaggaatccttgggccagggatgcttatggcagactccatttctcagcatggttttggctgggaatttcctctatgagattgacccttctctccccgaggtgccattttctggaataccaccttctctctgctggtaaaatctaatttaccttagtgccttgactggtctgcaaaataaatgttctgacgtttcctgacaggagagcctgtcctctctgctttctgcttctttatcattcttgtactttcttgccttgccttttccattttgatcttctctcttggccaagtcttgtcttccgggggctctcagtcaaagtttagtcccaccgatgtccagaacagaaagctcagtggtattatttttagagagggagggagaacctcttaaaagcatacttaaaattctatctgtgtgtgtcttttcatccttacatctgagaatattatttgtcttggcatgttgaatatggttactaatgcagatgtggtctgtgccttacatgttattcagtttgatttataaaaaatgaataattatataatagaatatttaatcactcagaagataatatatgttgggaaaacatgaaatttgaagtcagattaaggctaaattaatctaggtgagaagttggttttggccctcattgcctgtgtagacttggggtgagttgcgctcattttctgagtcttagcttatgagctgtgaaatggggatgatctgtacctaccttgtacagttagggtaggatttggatctgatgatgaagtaaagtacttagcacagtacctggtttatagtaagggtttaatggagagcattacttttgttatttaaaaaattatgtctattgtttctgtttctgtttagctctgagatctcctcctctttgaaaatgtcctttccacaaggcccttcccttcccatccattccatctgaccctctaccttcttctgttgttttttctcttacatcgcattctctccctatgaccaactatgaactcctgaaggaaagaaatccagtttattaaactgtgtgtcttcactccgtctaaacacaacaacatggacaaatttcacagatgtgttgttgagtggaagaagccagatacaaaagagtacacactttttttgaagttcaagaacaggaaaaagtaatttatggagacagagatcaggatagcggttcttttgaaggtggaagggttattcactggggaggtacccaggggagtcttcaggatgctataaatgttttaaatcttgtctcaggcctactaacacagatgtgtgtatgttttaaaaaatatttgattggtatacttagtatttgtgcactttgtacgatatagtgcagtaaaaattttaaaagatgtttcccagtatgcagggcttatttgccttttagtgatcattcagtaaaaggttgaatatttaatggatgtcatgatgaagtaaatgatcaacttttttttttttttttgagacagggtcttgctctgtcacctaggctggagtgcagtggcaccatcatagctcactgcagcctcaatctcctgggctcaagagatagtcctgcctcagcttcctgagtaattgggactataggcatgcaccacaatgccaaactaatttatttttttgtaaagatggtgtctccctatgttgcccaggctggtctcgaactcctgggctcaagcccccaccttggcctcccaaaatgctgagattacagctgtgagccaccgtacctggccctaagtggttaatcttaatcaccatgtgaccaagaccaaattttaaggaagatgtagcatacattttggaaaacatggtagacataattcataatttatagccagaattcacgctgttgttcatggcgctacttggatcttcacatagctgtttcagaaaatatagtaaatgcgaacggcaggacttgcaatttcagacagtttgtgcagttggcaggacagagaacacagagtggggatacggtcctgtcagattggtggaaaacctcatttttaattgattgtctattgcatctatgcccctcttttcccaccctccctttgtccttttatcaattctacttggaaataaaatctgcaactctaatagatgctactgacactcgtgcagcaattctaccagatggcattcgaatctcgggtgttctatgaaaaatgaaaagaccaaacacatgcacaaataaatgaaggttgaattaatctttataattaaacggaatattaccctgctatgactgatttttgctttcaaactggattgcgtgctaatttttcagtgaactgtaattgtattaacatggcttttttgatgcctgaaagtacttaaaaatagattttgcgaagttactgagagaaaagttattagaacttttaatctaaacatctctaagatcctgaggtatatttatatcacgacttacagctgcaaagcattttccaatagttttttattctttgtcccttatcatcctgggatttaggtggcactggccagaaattgggttgaattgcaagtacctgaggcacgttagaaaattgatgtcctactgtgtacccacaaaaattaaaaataaaaattagaaaacaaatatgtacaactgctatgtacccacaaaaattaaaaattaaaaaaatgagtgggagggaaggtggtagagttttctacataaagtgcacctactagcttagtagtggtgactattagtgaaatccctaaggattattgaagcagaggatgagtcccctacttatgaactgataacacagtgttgggggttctcagaagtgggtccagaagccttggtaccatggcaagtaccatgatctacagcagagagtatctcaaatttcagcaggcatgagactcccctatagtagtggttttcaacccagagtgatgttacacacctggagacatttggcaatgtctggagatatttttgatcacaactggggggacagagggtgttactggcatttagtgggtagcagccaggaatgctgctaaatatcctacaatccacagaacagtccccagagataagaatgattctttcccaaatgtcaatagtgccaaggttgagaaaccctgccttatggtaaggctcattataatgcagattcctgggtcccagttcagaagcattctaactcaagagatgtagcattgtcccacaaatttgtgttttcaacaagctcccacgtgacacagatgctgccagtccaaagacaaagctttgggaagccctaagctagacgatgccagtgtcaaaggaacaagccatatatgtgggcactggccctatgacattcccttcttttagaaaaatgatatgaaaattcccacttgcattgattgattgattgagacggggtctcgctccgttgcccaggctcgagtgcagtggcatgatatcggctcactgcaacctccgcctcccgcatttaagcaattcgcctgcctcagcctcccacgtagctgggattacaggcacacgccaccatgcctagctaatttttgtatttttagtagagacgaggtttcaccatattggtcgggctagtttcaaacttctgaccgcaggcaatccacccgcctcgacctcccaaagtgctgggattacaggcgtgagccatcgtgcccagcccacacttgtctaatttaataattcaccaaagttatctcatttgatctctccccaccagtttatgagggaggtacttcacaaggtttttaggtggtaaagaattgttcatataagagctaaccttaaaggaaagaatgacaacaattcccacttaaactgttgatgagacaaggggatatgtttatctaggttaatctccaacttgcctcctgtttaaataagtaatttaacaactggaggaggattaagtagctgattaaatttctctgagaaacgttaggtgttagggccttggtatttattgcaggtgtgtttctaagccctttcaaccttgatatttgaaaatgtttttaaataatttgtaagtattttttcccattccccaaaaaatgcattgatttatttcatagtatttattcccattttggttaatatttctatactggctgtgttttaaatgtagatatttacctcaacaaaatatgaatattacagctaattatagaattatttaaatagttattatttaattatatatttctatcttgatgaaactttccgaaaagattaacctttgtgccttatttttcccttgctatctttactattggttttgaaaaatggggaaacctcttgtgtagaagaggggttggcaaaccatttctgtaaagagacaaatggtaaacatcttaggcattgtgtgggctatatggcttctgttgcaactactcaaactccactgctgtagcatgaaagtggcagtaaacaatacttaaatgaacgtggctgtcgtcagagagaaaaaagcaacttttcctttaccactttaggtttaatgtcagggcctgtgaattaaactataaaagatggattaacaagagaaaagcaaagtttattcactaacctgcatgagagcttacagaaaacacagcccagagaaacagaattggggggttacatattgtcttaagaaggggtagggttaggattttaagggacaataaatggtgggaaatgactgagaaatatatgaggggacctaacagaaagtcaggcttgctttagtaaggtctgtttatgtaagttctcatcctggcgccaactttttatccccggtgagaggagttattttcccccggtgcaagaagtgtctcttaaaagggggatttacgacagttgaattcttttggaagtctctgcttgtaggccgataagggaagcatggagaaagcctctttctgcttgtcttgattctcagataccttcagctcaaaatagtcctttgctacagtagcatattccggaccaataaaactttctttacaaaaaaacatgtggtaggctggcttgggctgtagtttgctgacctctgatacagagccctgtgagtgagacagagacaaacataatttattttggctcatataaaagcctaagtgtgatataggattgttcccactcttgggctgttatcattttggttatgtctggataaatgggcttagctaattgaggcttagggtattcatttgactaggtctagcagctgttctatttgcaaactttgtgagcagtttaaccacatataatcgaaaccaataaaaacattgatttaaaaatttatgatttggccactcttctgcccagtttcttttcatctttttttttttaatttaatttttatcatttgggacagggtctcactctgttgcccaggctggagtgcagtggcacaatcttggctcactgcaacctctgcctcccaagttcaagtgatccttctgcctcggcctcccaggtagctgggatttcaggtgcaagccaccacgcccagctaatttttgtatttttagtagagacagggttttaccatgttggccaggctggtctggaactcctgacctcaagtgatacacctgcctgagcctcccaaagtgctggaataacaggtgtgagccacggtgcccagctcctgcccagttttaaaggaaataaatgagccgggtgtggtggctcacacctgccatcccagcactttgagaggcagaggtgagcggattgcttgagtccaggagtttgagacaagcctggacaacacggtgaaaccctgtctatattaaacaaacaaacaaataagggaaataaatgagagttgcctctatttttaaggtaatattgctaccactctaaggacgatgggtgtgttgttttattaattaatcataaggtggctttggcttctaaaatctattgctactacctgctccatctgtttaccaagaaaactcaaatattactttctttctttaactctgttcagtacagggctcacccaagtaagaggagcatcacaaagacaccagggaaatgtttagtgccagtatggcaaaattaagatttacttctgccagagtagtttccttttgcagacagaagaaactgcccacctccaaaatatattgagttggtgttttaggagagagcatggatggtgcttgtttataatttggaacatgccttcctagaatgttgtctatcttagagagtaatgagggttttctgctatactggggcattattcacatggggttgagggtggatgacctgaaatctgatctttcctgtcttttacttcttgtacaattagaactgtgatttgcacttagagagccttctgattcatggaagtgcttatctatcttctacccctgtatgatgcatctgcttgtggaccgcacccaaaagcaatttgcagaattaaagtttttgaagactcataataaatcagttcaattttatcaagagaataaaatttgattcatcagataactgcattgttattatttgtgggatcctgatagacccagaggatattaaagcctgttcccctgactaattttcatcaataccattagctccgcttagggtaatatcttcagctaaggcatctatactagtcaatcatttgtttggcattatggaaactgccattgttttgaatgatagtgtaattcatgtacagtctcctgaacttctgggtgcttaaagctcagaattttgattgatgtttaatagttattacagaactcatcagagaaaatgaggccttggcatgattgagcctgactgaagctttcaaagccactgcaagcttaggaaagttgccctataaattttttatgaaagggcagtgatcagttgttccatttttttcttaagttggttaaattaataaaaaagaaaaaatatgctgagacttaaccacgtatactaaacatacagctatttaattaagtgattaaagtggtctctttgatgtgatacatgcaagacatttgagaatttatctgactctcctaaatagccaagtcagtggggattaaaataaatgagctttctgtcttcctttctgtagatcagcttaatagtaagtggctttgaaaattcaggagtaaagcagtcaacctagccaatctttaaatcagttcagtcacatatataaaaagtagatgccatttcagagctcacagctaaataaagcagaattatgcctgattctgttcttcccaccagcattatcaagttgtagtatacagtattgaaaattctgggaaggtgggggtgatttgagagtttaaatcatgttgtatattaggttttcaatgttcctcatttttctgagttcatttgtgatagctgttgtttctctcttcaaataataatctttacaaactctctgttgtctccatggaaattaattgtgatttttaaagctctagcactaagactttagggcagggagtcaactcccaagcaactgagatctgtcgcatgtaaatggtagtaatagcaaagagcaaagcaaaaacaaataaaaatcttgatagctaagccgtgcgtgcacgtgcacacacatgcacacagatgatgctgttgagcatggatcagtttggaagcattgttaagcacttactgtgtactagcccctgtgtcatgaattgaggcaactcagcgaataacctagctttatttaattatctgtgttggcttagtaagttatggcccttgggccatatttggcattctgcctgtttttgtgtgaaccacaagttatgaatggatttcacattttttaaatagttttaaaaaatcagcttggcacaatggctcatgcctggaaccccagtacttagggagggagatgtgggaggattgcttgagcccaggagtttgagacctgtctgggcaacgtagtgagacctcgttctccacaaaaaggaaaacaacaacaacaacaacaacaacacaaaaggacaaaaaaacacaccaagtgtaaacaaccaaaagaagaatatattatgatacatgaaagttgtatgagattcaaatttcagtgtctataaagttttattggaacagagtcacagccattcatttatgtgttgttctagcttgtttctgctttctcaggtacaatcacagagctgagtagttgtgcagaggccatatggattgcaaagcctaaaatatttactatttggcactttacagaaaaagtttggttattcctgatatgggtaaggcaaacttcataattcctttattatctgaatacttctcccaactctctattttactttattggtattagaactaaatgtatccatattctacagacgaggaacctgaggaacagagagattcagaaaattcagctattgctaataccttatgtgatgatgataacttgttatagaatggttttcctcagctttttaaataaaaatgcagttaagtaatcgataatattacgtttgtatgttctttcagcattaaggagagtcctgagccttgattttatgttcagtatgtgtattagtctgttctcatgctgctaataaagacatacctgggactgggtaatttataaagaaagaggtttagttgactcacagttccacatggctggggaggcctcacaatcatggcggaaggcaaaggaagagcaaagtcatatcttgcatagcggcaggcaagcaagagaaagcatgtgcaggctgggcacagtgtctcacgcctgtaatcccagcactttgggaggctgaggcaggtggatcacctgaggtcaggagttcgagaccagcctggccaatatggtaaaaccccatctccactaaaaatacaaaaaattagctggacatggtgtgggcacctgacatcccagctacttgggacgctgaggcaggagaatcacttgaacccaggaggtggaggttgcagtgagctgagattgtggcattgcacttcagcctgggcaacaagagtgaaactccgtctcaaaaaaaaaaaaaaaagaaaagaaaaaagaaagcaagcatgtgcagaggaactccccttcataaaaccatcagatctcctgagacttactcactatcaagagaacagcacaggaaagacccaccctcatgaatcaattacctcccactgggtctctcccatgacgtgggaattatgggagctacaatttgagatttgggtggggatacagccaaaacatatcagtaagtatttgctgattgattgaaatagcttacataaaatatatagttttgtttgccaccaagaattaattgcattggaagctgagtgtggtggctcacacctgtaatcccagcactttgggaggctgaggtggacatatcatttgaggtcaggagttcgagaccagcctggccaacatgatgaaactccgtctctactaaaaaatacaaaaattagccgggaatggtggtgcatgcctgtaatcccagctactcggtgggaggctgaagcagaagatgcttgaacccgagaggtggaggttgcagtgggctgagattgtgccactacactccaacctggttgacagagcgaggctccacctcaaaaaaaaaaattaattgcaatggattttatatcttgcttaattttccagaatgttttatatgttctcacaaaatatctcattttctccccttttttctctcctgtggtaagatcagttaatattgaaatataccttaatgttagctgggcatggtggcacacgcctgtgatcccagctacttggtaggctgaggcacaagaattacttgaacctgggacatggaggttgcaatgagccgagatcgtgctactgcactccagcctggatgacaccgtgagactgtctcaagacaacaacaacaaaacccagggaaacgtaccttggtgtgaacagcactgaatgatgtttatgattgtatgttaatcctcttatatttaaaggttaaatgtaaaatatagccttttatattttctgatactcttgatgacattgatcatagtgggtttatcaaattattcattatatgaattaatatttattgagtattggtcacttgctatgttacctgtggtaacatggtgattaggtggaataggctattggtttaatttgaatagtattagaagattctctcagctacaaaacctctcatttaattgtatttattcctttggctaataaactactcttttaaataaaagtatttctccagagtaaatatattagattgctattagtgacttacattctattataaactagtttgaggccccagtggcagctagtggattagcaaccttgaagaattaataattttgatggatgagaagggaagggggagatatctttggagcacagagtattgctaaggaaaggccaactagggtacgatggtattgcaagtggtatgaacacataggacctgctaggtgttgaaaggaacagataagagaaagagaaagaggaggaaggcagaaaccaagatggcaagtgctaaaagcaacctgtatctttgatcttttctagggttagatttggtagtgtttcttgtgtctgttttcagaggtgtgccaatagtggctctcaaaagagtcctccaacttttggggggctgcaaatagcctggattcttttgactcatatgcagagtctggctttgctaggaaaatctcctaccatgctccaagaagcttgtacatttgtcttccattgataagagggttgcctcaatagcttttctccctaagcatttcttttctcgatatttttcctctcaccacaagtgtggccttctgaaactggacctatgactaaaagagtgacattatttctcaggggtttcaggtgtttggttaggggtataagatgacctggactcttctggaagacctccaaacactacacatcacagttactccaaatccttggaaaaagtcacgtttctactttcttggtgtagtctacaactaacatttgctcatcatgtactctggaccaagggaaaaaagtgttttacatgcaatgtcatcctgaactcttgcagacaatgctatgaaataggtactaatttttagtaatttttttctcaacatctgatgtaaaggagagtgtgttaggattacattagctaatggaaaacatgacacataatgcctcaaacaaataagggctttattttctgtatgtcatgaagggaaaagagggaggcagtccaggtctaatatgctggccttcgaatgccatcagcttttcatcccaccatcttcagcatgtagattttttcctcatatgtgttgccttgtgattactagatggctgctcggcttctggcattgcatcagcattccagaaaggaagaagaggaaaggctaaagcagtagttctcagctggaggtgattttgccaccaggggcacatttggcaatatatggagatatttttggttgtcacaacttgcggaggggggcatgggttgctcctggtatctaatttgtagaagccaaagatgctgctaaacatcctacaatttataggacaaaccccagagcaagaattatctggcccaaagtgttgagaaaccctggactcgaggcagaaagcatatgctgatgaatctgtccccttttaaaatggatcattggaagtgcaacaagaagtttttcttaaatgtcattggcccgaatctcatcctgtagctgactccagttggaaaggaagctgggcaacacagctattttgttgttgttgttgttgttgttgttgagtccattgtcatcctgagcagaattggagtcctgacagtaagagaagaaagggagaatagttattaggtagacagtaggcggtgtttatttcaaaaagttaagtactctgcctaaggtcacagaggtagtgaagatcagcagctgcgtaaacctcctctattgaggaacggatgtccagctgtcaagtgcagcttctctctacatgtctgtatgaataaagcatgaaaatgcatgcactgggtatggaaagccctggagtttttgatcagccacaaacagcctaggaaatatttcttgcaggatataatatgcaatctgttaaatatttatatcactgctctctcagcatttacagtgggacttgcctttcctttttgtccatgtaaccaatagggtaattaatctcagacctgactcactaatactttgcccttcaagccatcaaactattggtgcttcacttctcccattttgaaaaattaaaaagtgatgtgattactatttgccttacttagggttcattcaggaaaccagacactcttctaagtatatcaaccagcaagacatttaatacagggaattggaggcttaggtaacctttcagagggctggggagtgaagggcagagtctgtcaatgatctctgctgcttgtacaccaaagaggtctttctcaggagaatgcctggaagttgctggaaaagggctgtatctgctgtctgcagatgcccacatatctgtataaggctaccaacagcaaatgaatggcatctcctcttctacctttggaattgcctatgagtgcttctcattggcagtctaacctggagccatgggatattgcaagatgtatttctgaagcttctcagggaaaaatgtagaatggggtggggtaggatgaggaggaattgacaacgaagtctgtggcagaaaaaaacatttgaatctgaatagaggaatacatatatagcatattttaggaagaagaacactctcttcagatgttggcaatgttgctactagtattattaccttattctaggtatgtatctttgggaggtaaatagggattctttgtatgtgttctgattatcttcaagtcatgatgatgctcaataaataataaaaaaggattcaataacctgcatagatggtgcagaaggtaatatattctgtgaggctctgtagtgcagtgggggtcccagagatgaggtttaaaaaacaatgcataattcaccagcatgctctggaaagaccagtcttcagaaaacaattgtggatgactcagcttgtccgttcgttcgttcttttcttttcttcttttcttttctctctctctctttttctcactttctctccaaaactatctggaattctttacttgctatagttatgcatatgacttatagcgagctgataaaatatagtgcaaaattaaatacaatgccggaaataatagaataatctcagaatgaggtaacctatagatgtatgacatagtttggtgttgggggtagagttgtaacctctagttatctgctatctgggtcacatcaagcttttagtgtgtgtaactcacagagttttgaaggtgtaatttgatctgtgctatacttgagtctgtgaaacagcaaaacccattatgactatgtcctacagcccttgtaaaatcctaagtcttgagcttcaggattctgctgatatttaatatctgaattatttcaaggaaggtaaggaaagtgtactatcttactatgtttatttcttgagtgaggaaaattgaaagggactaaaggaaagaactcgttgccaagagcagtgtccagaggtcactggttttgctttgtggctttgctggaataaaaccaacgtgtttggggttgcctaggtcttatgttgggtcatctggaggcagatctggagatgagaattcctgtgtaagtgattcattaaacaaatactcccaagagaaatcagtaagggaatgggagaagcaagacagggagggatgagagtccaatttcaggagacatctcagaactagtctgatcctgcagggaactttggaagtacaaattatacctcagagtttgtcctgaattgaggcaagggggctgggctttcatattgccgcttagggctgcttgggtggaggcagaggcggaggcggaggtgcaggtgcaggaaaagtgggtagaaggcaaataaacccccaggaactagctatttttgattgcaggcaaggagctctagtagttcctagggcaggccttcagaaagtctcaggtgttggccattagaaaagaaaaaacatagatgctggagggatgtacagaagttataaaagggatcccagggaatctggtcagagccctgacagtgtacttgtaagcttctcttttgcttttatgaaacccagaatctggagaagggagagagaaattttcacatggaactgtaaagtttctctaaagcaagggttgacgaactttttctagaaagggccagataaaatatttgaggctttgtgggccacagggtgtctgacccaattattcaactctacaactgtactgcagaagcagccatagttgacaggtaaacaaatgagtgtggctatgttccaataaaactttatttataaaaacaggggtagggtggctggatttggcccagggaccatattttgccaatcgctgctcttgaggttctttatatgtgcctaagtttgtttttcctttatttattccctatctgttataaaacacagaggataattagtacctttgtctatctaaatgatggttatgacattatgatgtatcttaaattattctagatcactgcctccaatctttctggcatcctggccatctttcacaatgttgcaaagataatcttcctgaagcatgactcatctccttttattcccatgctaaacatatttagctctctcttagctgtaaaataaaatataggcttgttaacatggcattcaggaatccctgtgatctgaccccaggccaattttcctgcattattttctgttctccatcctcatgtacttatagtccagctacattaaattactcgccctctctccaatatgccatatcgtgtgtgtttgctatctccttgtagtttttttcatttttatgtatttaaactgactatatactgtcaaaattttatatatatatatatgatgtacaacatgatgttttgatacatgtatacattagaaaatgggtaaattaacatatccatcacctcatatatttatcatttttgtggtaagaacatttaaaatctactcccttagccattttctagtgtacaatacattgatattaactatagtcactatgttgtacaatacatctcctaaacttattcctcttatctaactgaaattttgtatcttttgaccaactccctaaccccattcccccacccctggtaaccaccatcctactgtactctgttatgagtttgactgctttaaatttcgcatgaatgagatcatgcagtatttgccttttggtgcctggcttatttcacttagcatgaagtcctacagattcatccacgttgtcacaaatgacaggattttcttcttttttaaagctgaatagtattccattgtgtatatatactacattttatattccattgtgtacatatactacatttttaatccattcctctgttaatagacatttaggttaattccatatcttggctattttgaatagtgcttcaatgaacatggaggcactctctttagcgtactgatttcatttcctttggatatatccccagaagtaggattactgctttgtatggtagttacatttttaatttttagaggaacctccatagtgtttttcatagtgactgtaccaaattatattgccaccaacagtgctcaagagttcccttttctccacacccttaccaacacttgttatctcttgtcttgttgatagtcgccattctaactggtgataggtaatatctcattgtgtttttaatttttatttccctgatgagtaatgatgtggatcattaaaaaaatctgttgacaatttgcatgtcttcttttgagaaatgtattttcacgttattttccctttttaattttttaatttctttttttttttttttttggagacagggtcttgttctgtcacccaggctggagtgcagtagtgtgatcatagttcactgcagcctctacctcccaggctcaagtgatcctcctgcctcaacctcccaagtaattggaactataggcaggtgccaccatgcccggctttttttaaaatttatttttgtagagacagggtcccgctgtgttgcccaggctggtcttgaattcctggcctcaagcaatcctcctgcctcagcctcccaaagctctgggattacaggcatgaacaactgtgcccgacctcctttccccattttttaaccaggtgatttgctttcttgatattgagttgagttttaaatatattttggatattaaccctttatcagatgtatggtttgcacatatttttgcctctgtctttgcccctgtttcttctcctggaatgttcttctagctctacattttgaaatcctaaccattctcttaagactcgattcagtcaccttctccattaagcattttctccatgcagaaacagtctctcctctggactttgataacaatattgtctatttctattaaattttttattttgtttacattgtactagacagttatttgctacattcactgcatttttagtatactgaggtctctcaatatatatctatatatttttgcccttcacagtggcttgcatatagtagatattcagtaaatggagttttcagatgaagggcgcatttctacatcttgtgattattaatgatttaagtgctgaaactctgacattatttttctttttcctttttgtaggcgagagctgttttggcaaaagttggctatccagagtttataatgaatgatactcatgttaatgaagacctcaaagctgtaagtgctaaatttactgtacttttttttttctggcaagttttactggccttgtgcctttcaactaacccaagtcctagcaattaaaactggtgatgccagaaaacaccaacttttgattaattccttggctagatatgagcctgaatatgccaggcagatcacaagatttagggcagattcaaaataaagaagtgtcagaaacgatgcgtagctgagtgggtaccaaaaaacaaatggacttgggtttggcctaatttgatcataaaagaaagaattaagcaaattgagtatgttacaattagtgggcatgttctaatggcaaatgcatcatgtttgttgttaaatactttttatttgcttcattcgtattaaatgaatagtaataaatctgcctgctgggagttaacttcattaaactttatgagtgttttggcaaattaaatgcatatacatacgactctataatttattgtgaattggattgtgtatttgcagtaagttactgatgaaaaatggtcataattcttttttatttcaatatttttggacatgtattttccagtaggtgtattaattacaggcctttctattcacaagcactgttatttcctctcctacaaatagttctgataagtgatttttcttcctcatttaaaaaaacctgtttttactattcactagattttcttgaaaatgtagtcttttgaaattctttaagtaactatagttctgaggtatagctctttcctgaaattgtggttcaacaagtggcatatctgaaaacgatcccagctttgtagatgagcatcaaaattttacaagactattcaaaagtgagagaaagcattaattagaatcttcctccattgggctctaagatatagcctcccaaaatattgatacagttgctctggaagaaaataatgatgcctcatagcatcctaaaactcagtctatcttattatacactgttttgatgatgctgaaaatcccattattattatcgtaactaaaaatattgaagcacttgacatattcatgtacattatcttttaattccttcagtgattctgtgaaatagatgatgttcattcccattttgcagaaaaggacatagagactcaataatttaagtgagctcctcagttccacacagactttcagagccaggactgatatctgggctcaggaagctctgcctgtaatcagacaagggattcttgagggtcctttttaggcagctatgctggaggaacagaggcatcagggtggagacttggtgggggcagtgtgaccagggctgttggaagaagagcagagggaaggccatgttatcaaatggttaagagcacaggctccagtatcatgggcctgggtttgaattctgcttcttgtacttactagttatttcatcctgtgtaggttacttaacttcggttagcctccctttggttatctggctactggaaatataataaccaagtcttagtattgttgggaagattagatgagactgtataaatgtaaaagcacttggcataatactctggctcagagtatagcctacttcctataaagggtagctttgcggatcaatatggaccatttgtggtccattttcaaatcagccatataaaatattccatttcattgatccttaatagaaatagactcaagcgtgaatttctaccaattttggaaatatatctgtatcagccaggaaagcaaaaagcacagtaggtattttaaacagggaatttaatacaggaaatgggttggaaggcaagaaaagggaaaatagataaaccacaggttaaactgctgttgctactaagaagagtatcatcagggcacaaagtaccttagcaggagaacctgggtaactccatactattggtatatattctgagtcagcatgtggatgagaaggtttgagagacagtttgatgtagaggttataaatagggaccgtggagtcaaagtgcctggagtaaaacccccagtctaccatgtaccaccttgttacctagggtaggttatgtatcctctctgtgcctttcttcatctgaagaatgaaggtcataccaatccctcccatataggatttctgggaggatcaaataagttaacatatttgaagtgtttagaatgaaccctaacatacaatcagcacaatacatgtgttagctatgacatcctcaattcacacttgtggtagtgaactattttggtttgaaaaagtcctcatgaattaactcatgcactgtccaggtccctcaaattgatttaaaagggtatacagatggagcagtctcaagctttaatcgaataaggtagaacttaaggcttactcacaatatttagttgatcaagttttgttggcattctgttgctaagttcagagccccaaatttaaggacccattgaatgcaatatcttttgtgaaaagaaaccagatgccaaacaggatgccatgttggctgtgcttctttgtttctctggggcctgaactgaagacattacacaccaagatttttaatcacttctttgaagaaatggctttcatctgactcattgccaaagcagacacaattacgcccaagagttttaacagtttaaaaacctgacagtgaaaaaaattccaggtacatgaagtaaaaagacatttgtattcagaaaccgattgttttagtcaatttacacggtgctataaagaaatacccgagactggataatttatagaggaaagaggtttaattgactcacagttccacacggctggggaggcctcaggaaacctacaatcatggcggaaagtgaaggggaaacaggcaccttcttcacaaggcggcaggagggaagagtgagagttcaggaaaaaactgccacttttaaaaccatcagatctcatgagaactcactatcacaagaacagcatgggggaaactgcccccatgattcaatcacctccctcccttgacatatggggattacaagtccctcccttgacacgtggggattacaattcgagatgagatttgtgctctctcactttctctccccctcaagccccgcccttttctttttctgacagtgacttcagtccctcctccaaacctcagctctggagtggcaggcagttctcctctactctcctaagtgatggtaccatcacctcctcccttctgtgaccctagacacaggagtcgcagctgtgtactcctgtgactctcacagagccaaatcatatcactgatagagaaaatgaataaaacccaccctaaaaataggtaaaggatgatatgatagattgtaatattgtcactgagggcaatagcaaaaagactgaagtattcctggtacacaatgagactgttttcagttttaagaaacatgtagataaggactgctataggacctatgagaaatttctggtaatacgagctctgagcatgagaggctgttacaaatgaaaaacagcatgctgcatttgagacaggtggagatatgattcatcaggcacaaatgcaaaaggaaagaggagcgagattacctgatggatcagacgaaggtcaaggagaaatgttgaaaattgaagttgggctcatgtggaaataaaagcaaatgagatagaattaagaggtaaatatgcaaaggaatcagaaattttttaaggatgacaaggtaaactgaggtactcagcaaagcatttccgaacaacaatcttgtagtttttgaaaagaacaggaagaaataaaatgccctttatttgaacccccatcaacatgcaggaaagcctgttagcctaaaaaggtaggcatgagcccattttcaaatcagcctaataaagtattccatttcattgattcttaatagaaatagattcaaaagtgagtctctcccaattttggaaatatttcagtattagccaggaaagcaaaaagcacactaggtattttaaacaaggaatttaatacatgaaatatgttggaaggcaagaagagggaaaaatgagataaaccacagattagtaactttagaaagcagctgcgactcctgtgtctagggtcacagaagggaggaggtgatggtaccgtcacttaggagagtagaggagaactgccactccagagctgagctttgcaggaggaactaaagattcttccagagttattgtcagaaaaagaaaagggagggagtagagggggagagagagtgagagacagcaacacagcacccttttcccttctgcaacccactaatttcctgtagtgcctcctatttgcaggaagctaattggcaaaggagcttgagaaacagttttcagattcccagtccccagcattacggaacagagtgaaagggtaggcatgtagctgaaaaactacaggtaaataactggcactattaaggacgttactaaggaccaaagtcagaatcatggctggcctccatttacttaggagaattggaaatgagaaaattttcagaggccaaagtttctggtgagtgatacacacatatatagacataaatgtgcatatagggatatgcagatatgtgaacctatgtaagattctctgtggtgggtctggtctactttggccagtgaaacactagtgtgtgtgtgtagtgtgtgtgtgtgtgtgtgtgtacatgacagagagtgccactctgcaagagtgaggtgatattcagatggaatgctagaatgctgcagaaaaagaggttgttaaaatattaaaataattctttactatttgttaaaaaacacaaaacattgcgctcagctctttcaagggacccctggccatcatggcactggagagctaagggtgggcattggaggtgggacaccctggtgccccccaaccttccagccaggcctctgtaactctctcacattggccttcatccagactgttccactggtcagagcagaccaagaccagccccagtgtggagatgggacatctggttccagtgctagtgtgctggctggaactccctcagacccaccttcacatagctgtttgtaggaattgcatcctccatggtacactgtatatgtggattattaaacattttgagcatcacctcagtatatattaggttggtgcaaaagtaattgtggtttttgccattactattaatgccaaaaactgcaattacttttgcaccaacataataagtatgtctacatgtatagacacacattacttttgggcaaagccatctaaacacaccaatcttgcatgttgctttgttgtttgaataaggggacatgtagatataaaatacggattccattaagtattcagaaaatcctttgggtgcctaacataaagtctttctaatagatatttggatatatctctgagtatctttaaatggatttaaattaaatgaaaggtatcctagaatttacacttcctactggcacagtaaggaaagtaccacaattagtgcttcagtatttttcatctgcctattcctacatgtaggccgaagactatactacagatcatttgcattcctatgtactgccttataaacatgtacttatcctacagagaagctgaacacatttccttgttctgcgcttattacaggttctccatctttggggtggtggtggtggtaataactttattcttccatttagtctgtggatctgggataggatattcaagaagagaaatgtaggctctcctgaattttatgatcgggacagctgttcctgggaaatgacacaagaatcccaattaattccccaaaggtcacgcaattgaaaagtcaagagatggaattgattgaaagtgatcatcaacttgacctagactttttccagtaactgaaaggacaagaggcttttgagccaagtattgtctcttgccaaatttaattttttcattttggagattacaagcggctttaaaatattcatgcgaattcattcttgtttctacttctagaaaaaatagaactttctcaatagttgctgggtttcaattctttttctcatccaagggccttttgaaatatttaaaattatcaaaatattattacaattagcaagtcttctaaaagtaaaaactgatcccactgatattattttttaaaagttaatatttttgaaggaaattcttctgagaaaatttcccagaaagtgttctgagcccaagaacatatctgaattttctatcagttataatcatattctgaaggttttggcagaaaatttgggaactagagaaaacgcactcataatattgctacataatatatacttctgttacagtttattaatttgtttttctctatttctgtactgccgtaattgatgtttacatataatttggtacaccaacctttacagtaacatattgttttgctactgtctttatagcctttgttaccatgattttaactgctgtatagtatttcaagtaagttgtatcatgattgatttaatcactgcttctactcccttcctcaatctcactttgtccttgaatcactggttctcttattaagaccaacgaaaataacattggagtcagagccaaatgacttggacggtgtagctttgccaaattccgtaatctccttagccctgtttcccatctatcatatgtgaataacagtgactggcccctgcctacccccaaacacttaacctgtctcaaggaaaaacgtaagacctgtcctctattacttgtgatttccattaaataaatggaatagatcaattaaaccaggctaagaaagaagaaatattctcaacttaataatgaaaacaatttttaaattatctttctaaacataaataagctatggcaaattgtaattaattacctctgagttttgtttcccccaattattttcagggttctggtaggtccttacttatctaatgtatttttagacttgggacccttttcttctttacaacgttttttttttttttaatttttaggcagagtctccctctgttgcccaggctggagtgcagtggcacaatctcggctcactgcaacctccacctcccaagttcaagtgattctcctgcctcagcctcccgagtagctgggattacaggcatgtgccaccacacctggttaattttcatatttttagaagagacgggatttcaccatgttggccaggctggcctcgaactcctgacctcaagttatctgccagcctcggcctcccaaagtgttgggattacaggcatgagtcactgtgcccagccctttagaaagttttgagatggctttctgtttaatgtctgtagaccaacctgaatatcaagggatttttttttttcagatggaacagtaatgaaagtatcacaattagcaagttttctaaaagtaaaaactgaccccactgatattatttttaaaaagttaatatttttgaaggaaattcctctgagagaatttcccagaatgtgttctgaacccaagaacatacctgaattttctatcagttataatcatattctgaaggttttggcagagctgtcttggaaacaaaagctgaaaaaggcaaagggttgaacagtggacacatcttttaaccatatgatctgggaatgccttaggattgctagtaaggttgctttctataacaaggtgcttactctgtttcttctgaggctaaaagaaaacctttatcttaaaatataatcaattataagattttggccagcgcggtggcccacacctgtaatcccagcactttgggaggccaaggtgggcggatcacttgagtccaggaattcaaggccagcctggccaacatggcaagaccgcatctctactaaaaatataaaaattagctgggcatggtggtgcatgtctgtaatcccagctactcgggaggctgaggcacaagaatcgcatgaacctgggaggtagaggttgcagtgagctgagattgcactgctgcactctagcctgggtgacagagcgagactgtctcaaaaaaaaaaaaaaaaaaatatatatatatatatatatatatgtatgtatatatgatttctttttattatgaagcatttcaaatgttggaacatgagtaaaataatttgaacacatctattttaacacatagtaaacatattgccatattagctttgtacatgcacacacacattttaaatgaacagatgcatttgaaattttgtctgtaatcttccttgatctaatctccttcctctgcgtctatctccatctctgcatataaacactaccttgagttcagtcttattattgttattcccatgcctttctttatgcttttgctacataggtacgcatccatcaacagcatacagtgttgttttgcatgtttaaaaactttaaatttcctcatagatacaacttaccttattcactctgcataatttttaagattatttcatgttcatgcatacagaacaatcatgtaaactgttgtattgccttccattatgtgaatataccacaatttgtttatcagcccctcttccctgagcaagcagtttgagggacaatttaaagtcatagtgttataatttgttggccaagcagaacacagagggtgccaggaatcaatacttttatttctgcctttctccatgtgccttcagttattttactccttcctttatattttggcttggtctcctggaaagattgttaagatgactccttaacaaaaacttctccacggacatgagaacccactctgtgttagggaggagctaaatgtgagccagacattggtcaacaagtaggtgactgtcgagcctattaccatcaaattgcatatatacattcgtatctataatgtaatgccttgtgggtttcatatacacgagtattttactttttgcttttaaaagactattaaagttataaaaattacagtttataagaatttggttacccttggttatctccttattcaaatgtgtatttttcttaatttccatagtaatatatttaaaaacccaagcattggaggtcactacaaacgattgcatgaacagctccacagatcttatttacaataaatagctaggttaggtattgctagttttgtagatggagtgcctatagaatggaaaccgtctgccattctccttccaaaacaaggaaaggaactaaaaaagcaattatgtctgtttccttgtcttaatagacaacattgttgtgagctgctaccagctttctgtgttcccatgcaagctataatctatgatttgcctctgtaatttcattaatatttagtgaccagagactttttgagtgttaacagatacattctgttaataattattctggtgacttcattgtgcttatggtggaaaataggtctctgaatcacatttattgttttcctttacgaacaactaccaattatttgactaaatcattgtctataagctaaatgagttttcagccaactaaactgcatgttactgaaaaaacttacgtgacaaattaacaaagtacacattttaaaaaagatcaaggactcgtgagccaagaaatttcaaaccaaagataatatggtttataaaggttgaagtagatttttcaattagaaagtaaatggaacgcattgtaaatgactgcagcttctcttgttgtgtttttactgtgatccagaaatgactatattgatttttgaagtttttacgttaacaaaatcactgagactaaatttcatggctttgtgacttctgggtcaactgataacagctgagagaggctgtgactgatgcagcttctctgctagttgctccttcctatgctgaagtatttttttagagccatcttttatctttacttagaacaatgatgttgtggtttgttttattcagatcaagttttcagaagccgactactttggcaacgtcctacaaactcgcaagtatttagcacagtctgatttcttctggctaagaaaagccgttccaaaaacagagtgagtattaaacaaaaaaagttaaatagataaatacattggtgagaagcggagtctctttagattaaactttgtaattcccctcaagtcagagtagctggcttgccagttaacttgttttagcaaaatctgtgtcatgttttgccaactcttattttttatattacgtgattcagatcttaagtctaattacaggtcccccatttctagcatcaacacatatcaagagaaggcttattagaatgcaaacattaaagttatgtctagatctagttatgaatatatagagagggaataatttctctggatttttacattcatgtaataacttttgaagaccttaaaaaagaataaatacttaaactatgattagaaatgtcaaagtaaatgtatagaagcaactagaaaatatttgttgaggtaatgcctatcaaagaactgatagctatattgtttttatctaatagcagttatgatttatttgccttcctctcagctgcctataggagtttttcctacagataggagagtttccttaggaacttttaggcccagagcccaccagctacgatttcatcccttagcaaaatgtcagtgatgaatgtagcagctaacaattattatttgtttacattgtaccagaaagtgctttacaatttttaattcattttatcctcatacgaattctgtgtggtataggtactgttatccccattttacaggaaaataaaaggcttacaactgagaaattcttcagcttaggtttggatcacattttgttctgtctgctggtgcttttgattcctgggactggattctgttctgctaaggcccacttctccaatgcttttttttctctctgttctccagattggataatttctattggtctggatttcaactccagaatttctttttttaatttaattgtattattatttttttaacttattttttatttcaatagattttgggggaacagatggtggttggttacatgaataagttctttagtggtgatttctgagatttcagtgcacccatcacacgagcagtgtacatgtatactgtatcagtgtgtagtcttttattcctcacccccctcccactctttccccctaagtctctaaagtccactgtatcattcttatgcctttgtgtcctcatagcttagctccctcttatgagtaagaacatacaatgtgtggttttccattcctaagttacataggataatggtctccaattccatccaggttgctgtgaatgccattatttcattcctttttatggctgacaacttcggaatttccgtttgttttttgtagtttctatttctctgttgtgattctttgttaagtcattgtcatcatattttctattaattcttcaaataaagtttattttaattctttgaagtcatctataatagtcactttcaagtctttgctaaatctaatatgtgggctcaaactaactagagttagtttctattgattgcctttttattaaattaattaatttttttttacagtttttcctttgcttaacattttttgttgttgttgctaatgacagtttagatagcatgttgtagcaactctggattctgatttatttttctgaggctttttttttttaaaatcaaaagtaactgtcctaacttatactgccgaatagatcttctctgtggtatgtagctgtcgatgtctccactcagttttttaactcttatttgtagttattagcctcacttcctgctggttgtccctgtgtctacatagcttagtgctcaatcagtgattaggtcagagcttgtgcttaaacaccttgagtccatagggcttctaccctctgccagttgctctgtgtgtgggttgggagcaccttcaaagttatagccagttctcagtccaccttcaatttcaccttccaccaggccctcactggtcttccctgcacatgtgcctagtttcccagtcagccagggatgtgtggagtgcttatttggcccttctattactatttcagttataggatctctcttttaaatttctgactgggttttcctcgttagttttctactaagttggccattcaaaaattaaaaaaaaaatgttgtgggtatgtagtaggtgtacgtatttatgaggtacatgagatatttcaatacaggcataaaatgtgtaataatcacatcagagtaaatggggtatccatagcctcaagcatttatcctttctttatgttacagacaatccaattatacagttttagttatttttaaatctataaaaagttgttgactgcagtcaccctgttatgctatcaaatagatcttattcattctatctaagtatatttttgtacccattaaccatcccctcgacccagtacccttctcagcctcattctactctctatctccatgggttcaattgttttcatttttagctcccacaaataagtgagaacatgtgaagttttctttctggggctggcttatttcacttagtattgtctagtttcatccatgtagttgtaaatgacaggatttcattcttttttatggcttaattgtactccattgtatatatataccacattttctttatccatttgtctgttgatgaacacataggttgcttccaaatcttggctattgtgaacagttctacaataaacacgggagtgcagatgttccttcgatgtactgattttctttcttttaggtatatacccagcagtgggattggtggactgtaaggtagctctatttttagttgttcgaggatcctccaaactgttctccatagtggttgtactaatttacattcccagtaacaaagtacaagggttctcttttctcaacaacctcaccagaatttgtttttgcctgtcttttgaataaaagccattttaactggggtaagatgatatctcattgtaatttttgatttgcatttctctgataatcattcatgttgtgcaccttttcatatacctgtttgccttttgtatgccttcatttgagaaatgtctattcagatctttgtgtctatgtgtctgtttttatgccaatatcatgccattttggttactatagctctgtagtataatttgaagttaagtaatgtgattcttccagttttgttgtttttgctcaggataacattggctattctggatcttttgtggttccatataaattttaggaatttttttctatttctttgaagaatgtcattgatattttgatggggattacagtgaatctgtagattgcttttggtagtatgggcgttttcacagtattgattcttctaatccattaacatggagtatctacttttttgtgtcctcttcaatttctcgcatcaatgtttttatagttttcattgtggagacctttcacttctttagttaagtttattcctaggtattttattttattcgtagctattgtaaatgagattatcttcttgacttcttttacagatcgctttctcttagaatatagaaatgctactgatatttgtatgttgattttgtatcctgtaactttactcagtttatcattttaatagtttttttggtagaacctttaggtttttccaaatataagatcatattgtctacaaacaagggtaatttgacttctttctttctaatttggatgccccttatttccttctgttgtctgattgctctagctaggacttctagtactatgttgaataatagtggtaaaagtggacatccttgtcttgtctagatcttagaggaaaggctttcagtttttccccattcagtgtgatactaactgtggctctgtcatatatgactattactgtgtttaggtatattccttctatatccggtttttcgagagtttttatcctgaaacgatgttgaattttattaaatgcttctttagcatcagtttacatgatcatatgccccgtgtttctttccactgtgataggacagcactgagttccagtgcaaagtcccacaatcaccgtactctccttcccccaagcgcagaggtttttctctctgtgcccatgtggctgctgctggggaatgagggaaggacggtataggcaattcaagactggctttcctaccctcttcagtgcctctttccttgatgtgatgttaaaaccaggtattgtgattgttcacctggattttggttcttatgaagatgctttgtgtgtgtgtgtgtgtgtgtgtgtgtgtggctagttgttcaatttggtgttcctgcagggaggacacttgctggaggtttctacagccttcttgctctgcttcatcctctatgttggccatttttatctgacaaagctgtggcttttcactgccacccccagttgagtctacccactggggcagcaaagctgctgatttcccagccagcctttttctgacaaaactaaggtctcactgagctaggagggacaggagtagtctcaggcaaaaaggccatagtgcctgctctacttaatgccaagttctagcagtttttaaatattaaattttgtttaatttattgctcccccttgatgaattcccagattcctaaaatggttatttgttgacaatgttgtccagttttgtacttggtttttgtagaaatgatttgtcaaccttctcatgccattatacctgcaagcctggcttccatggattacaattttttttttcatggcccactttttaaccttggctaatattctgatttctagatctttgactggctgtttttatgctgcctagtcttttgctactctccctttcaagtccctgttctgtcctggcttctagaaactctgagcccctgtgctttcccttggcttaagtggtgattaccacttctccctcttatgtttccatccggccatccctgctctctgcccttcaaaccttcctataatatgcacctgaaaaattcattggaggttactgactttaagaggtaggcctaaagctgaatctctcccctacctaaccctgactccagtcaaaagcacaaaggaaaacagctttagaactgctttgaaaaatgatagataatggtttaaagccatttgctccactgtctttggttctttcctctcatcacgttatttctcagtccacctatcctgtttcattcccagtctaaattattcaatagttttagatttaggcttcttaaatccaatactcaaatctgatgactttggcaaatgatttccagtatccctatgaccatctacatgtaatacggtagtcacagatctatataatcttgcccttcaatatttgcttcagatcagttccaactcttttttaaaaaaaaaaatctgtggaaaattgaagggtttcaccaattttttggtgaattttcagggtcttctcaggggctcctgcatattggcaatacagtcagtctaattgtttgatttcaaaatgtcattattcatttagttgtgtagaaaggcctggattagtaattgaaaaactcctaaatgtgttatctttaacatcgtcctaggatactgatgaactttcagattctaatggtcttaactatttctaatattttattcatgccttagaaatatactggctttgcaggcttaggcaaactgagatttgtgtggttttcttttctgtcattgaaaaacaaatagctctttcacaagggtattaaattggttaacttttgggaaaagttctccagaaatggaaatcagtgcaatgcttgtaattcttgtttcctcagactatatgtctatttcagggaaataacatttagaaatttaaggtcttctttgcatagtaaagggatatgagtaaattccttttccttcttgttttttttttttaaaggaaacatctggctggaccttttcaggcattgtagagacttttagcctcatgatactcattggcttgaatggacatctttcaggtctgaaaattcatgagttaatcgagtggggatcattctggagtagctctactacactagtttactttgaacagcatcatgattatattttcacaaagccctgaaataacgttttgcttctttgtgggtgtaggagataaagaccctttatcttttattctcatggaatccattttagctgcactaatgtgcattaagaagtttctaaggcgatgggaaatgtcagcaagaatgaaattaattgggtggtcatccctgaaggtacatatttaggggttggttcacagaattgtcacttcatcagcttgcttaaaaatagaggatttacttactgctcggcttgagttgaaagtaatttctttccctcaggatcaccttctttgacagaaattattttagcccgcctcacttttaactcactctcattctactgagaccaaacacgtctgaattctctatcttttgaaaaatatgtaaaaatgcattaaatgtctttataaattatgttcctgcccagaacttttgtttgcaaaagcattatctatagcatggaatgtgagtgatataatctgcaggatattaataagaaagcaataaatacactattgcttttccattccatattccctagactatctgtaggagttgataagaaaaatgtaaaactttagcctgatgtatatctattttatatggtccaaagaaataggtgtaccaatgtctttttcttcagattcttgtattttggtattatattccttttatgtatctcattctccagtataatttcatccccattattgtgggatttgaaatttctatgagacctctccttaccttatccaccaaatcctttctcaaacacagactgcagaagcaccctaaagacatagtaagaagaatttaaagcacttgaatgatattctctgtttattgaagtggatgtatacatgcaataaattcattttaatggatttagtgatcttctgttcagcacttaccatttggacaacagtcaaagcccataagcaacttaaaatcttgttgggacataagctgtgcaaactcagatgccttcaggggccagtcagttaacaaatggttgacctacatgggtgtaaacaacagggagtggtagggactgtagaaaactagtaattacacacaccacttgaaggaattccaattcaatagtttgttaagccattgtgttgggcaagcaaaacagttttctgggaagattcagcccattgggttggacttagtctgtggatagccaacttttcagcattccatttatctattgctgtgtgataaacctcccccaaatttagagtactgaaacaacagtcattatttttctctctcatggttctgggggtcactaggctcagctgcatggttctcgtttgtggtttttttttttttttttggacacagagtctcactctgtcaccaggctggagtacattggcgtgatctcggctcactgcaacctccgtctcccaggttcaagcgattctcctgcctcagcctcctgagtagctgagattacaggtgcccgccaccacgctgagctaatttttgtagttttagtacagacagcatttcaccatgttggccaggctggtttcgaactcctgacttcaggtgatctgcccacctcagcctcccaaagtgctgggattacaggcatgagccactgcacctgaccatttgtggtctttcatgtagttacagtcagatagtggctggggctagagtcatatggaaggctacctctctcacatgtctaatggttgatgctgactgttgactagaacatctacatatggcctcttcatgtatgttgggtttccttacagcatgttgattgatatagaaagttcaaagagcagcttttctgagaaagaagaagggagggagggtgtgtttgtatgcatcagggggaagttgtatcacctttaattacctagccttggaagtcacactgtcatttctgctgcgtattattctttagaagtgagtcactaaggctaacccataatcaaggggagaggaatttagattccatctcttaatgggaggagtgtaaaaaagttcacaaacacatattaaaactagcacatgtagccttacattagagaatagtaaaactaaatatataataaacttggatgtaatacgggagatatacaaaatgtttaacagctggtttggcatgggccctgaacaaatagaagaaataacagcatcaacaactggtaggatctactggtgcagctgcttaatatcagctctgggtattatcaagtctccatacgtgccctagagtcaataagagccctgggaggtcaggaatggtaagatcatgtgtctgaaataagatgttttcgttattcttgttgaagcttcagaagccccattaaggtctagtttcagagactggttgtttggtttgctttgtctacctttgtctaccagcagttaggaacattttccctgcatggcccttacctgaatattttaaaagtttgttattttaaagagaggggagttgggaagaacaaaaagagaagggacaagctctaggaatacacgttatcttttgtatgtattatgattcattccagtgttatttagaagccaaggcacccacctggattttcccctcttgacctacaaatgttgggttctttggatagtgcattagtttcctattgctactgtaacaaactcctacaacctaagcagcttaaaacagcacagatttattatctcacagttctctagctcagaagtctagggtagcttggttgttttctctgctttggatttcataaggctgaaatcagagtgtcagccggctgggctcttatggggaggttctgggaataatccccttccaaggggattcaagttgttggcagaatccagttctttctgattgtaggggtaaggtctttacttccttgctggctatcgcctggaagccactctttgttctcagagggatttatgcagtccttgcccattgcccctacatcttagagccagcagcgtgtcaaatccttcttacccttcctcctctccgacttcctcctctgttgcatctctctgattccagccaaacaaggttgtctgcttttaagggcttgtgattagattgagcctacctgaataatccaggataatctctctattttaaggtccttaagcttaattacacctgcaaagtccttcttactatgtaatgtaacatgttcataggatccagggattaggacttggccataattttacctactacaggtagccaagttaggtcaatagaggtgctttccccttcacttgtttcctcaggaaagtaggccaaccagcaagtttatgttaaacactagggcttaattgaaataccctaaatttgaaggaaaagaatatgcattttatggaaatatgtctaggtttcggttttgaagagagaagaggtgctctttcttgatttccagtaatgtctacagtataatataatgcttaggcgaactggtttgaagtcagacagaccaggcctcgtacaagcacataatgctcataaatctcattatcctcgtctgtgaaatgggctaataattcctatgttgccatggggaaaaactgatgaatagaaggtgcttaggacatagtaagtgctcaatgaatgttagctaaatataatgataatgataacagaatgacatattcatagacttctttgtagctggggagaaggtatgagtttaccaactagtatcaataattgggtttcctattagtttcatattaacctgatataaattaatttgttagtctgacataattatcctattagacgtaaatgagtaatacaattattctagaaagggatttatacaagttttttttttctttttaatttttttagagactggaacttctgggctcaggcagtcctcctgcctcagcctcccaagtagctggaactatatttgcatgccactgctgggcctaggagtttatttttagcaattttgcttaagatgaattgcttggttttaatcataacaagcagtcactgaaactcacaaccatctaagtcagggtttggccactatggcctgtgggccaaatctcacctgctgcctgtttttgtgtggcccatgagctaagaataatttttagagataaatgtttgcaggtggtttgatgatggggaagccctaactttgttctgttttttgtttttgttttttaattaaaataacttttgttggtacgtagtagttgtaaatatttatggggtacatgagatattttgatacaggcctgcaatgcataatcatcacatcatggaaaatgggagtatccatcccctcaagcatttatcctttgtgttacaaacaatccgcttatattattatagttatcttaaaatgtacaattactattgactatagtcaccctgttgtgctatcaaatactaggtcttattcattctttctaactatacattttttgtacccattacccatccccacttctcccccattcccctaccgcccttcccaacctctggtaaccatccttctactctctatctccacgagttcaatcgttttggtttttagatcccacaaatacgtgagatctcacaaatacgtgagaacatgcaatgtttgtctttctgtgcctggcttatttcacttaacataatgacctccagttccatccatgtgttgcaaatgacaggatatcattctttttatggctgaatagtactccattgtgtatatgtaccacattttctttatccattcacctgttggtggacacttaggctgcttccaaatcttggctattgtgaacagtgctgcaacaaacatgggagtgcagatatctctttgattattttctttcctttgagtatatacccagcagtggggctgctggatcatatggtagctccatttttagttctttgaggaacctccaaattggagaagcataactttgaaccccaattaagcaaaaggttatctcatcccaaaataattccgttattctcattaataggcatatattagaaataattgtactcagctgggcatggtggctcacgcctgtagtcccagaactttgggaggctgaagtgggtggatcacttgaggtcaggagtttgagaccagcctggccaacatgccgaaaccctgtctctgaaaaaaaaaagagaaataattgtacttgattactattgttattttttggatttcatcaataaaatttgtggacagtttgctcttaagtacctacgtaatatccttgattttgcctctttgcctgtaaagcctaaaatatttatgatctcactctttacagaaaaaaatttgctgactgctgatcccagtaacctattgtgcatttaaggtttgggtgtagactccttttagatagaagggatcctttagatgtcctaatgcaatgccttaattttatagctaaaaccaaaccccaggaaggtaggtgactcttcccacacaattcagctagttagtgatagaggcagtacactttccactggagcaggcagaccctctgggtggcatagttggactttattcatctttctttaaatggacctctgtgttgtcaccaatccagaacttttaaatggacaggccagaggtaatgcagcatagaaacccaattgtccattcaacccattgaatagggcctggcaaatatatagttgctgtgtttccatttgcagggacagccctttagattctagaatttctctttaaaactttttcaaaagcactggtgtgctgactttttttctgttaagttagtaacaataaataactgggcatgttaatatattttcattgagccatgttcagtttaggatgagattgttcattgagcagtacagtagccccaaactgagggaataatttcccctcatgtccaacatccccattgttccatgttatctgctaataaacccagccatgctgtgtttgtctttgcttccctcctgcctgtataatgatgattgctctctggcatttgtttctttttctacaggtggtttacaaatccgacgactgtcaatgccttctacagtgcatccaccaaccagatccgtgagtacgggttccttgtctccttggtaacctggtataaaatgcaaagaacttttccatgactatgatggagggtaagacatttcttatttcccccaaaagtggcagggtatgctggtgaaggaaggttgttctcctacctatatgccaaattttcctcactctcttcaccttaccagttttttttaaagctttatgtcaccactgattgaaaaaaagtcaactacagtaaaccaaattaaaccataatgaagtttgccatgaaaaggagcaagtttccactttcctttcataatggccttactgattttgtccatgccattttattcattcctaggattggtggggaaaacagcaggtaactgagcagattgtagaacctgagcggaccatctgtatgtaagaaagaagcttggaaatattcttattaacgctaggaagttatgtcttgaggttttctacttacatgtatcaggtatatgtaattaaaaataccatgataaatttaaaaaattattatttttattattttttaaagacagagtctccctctgtcacctaggctggagttcagtggtacgatcctggctcactgcaacctctgcctcccaggttcaaattattcttgtgcctcagcctcctgagtagctaggagtacaggtgtgcaccaccacgcccagctaaattttttttatttgtatttttagcagagatggggttttgacatgttgactaggctggtctcaaactcctggcctcaagtgatctgcccaccttggccttccaaagtgctgggattacaggcgtgagccactgcacctggccttaaaaaattattaagatctgaatggcacaaataaaaagtctgacagcttccagccttggcaataaggacacatactcactgctggtggaaagatagatgggctcatccactttgcagggcaatttgacaatatctcaaaaagctgaagttgtgcatgcatacctatgaccatgatgtgtgctcctggaatgtgctctaatgttgtgagtcttgaaatgtggtccttggacctgcagtaatagcatcatgggggatcttgttagaaatgcaaattcccaggccccaccttaggtctattgatcaaactttggatgtggagctcagaaatctggtgcaataaaacctgcaggtgattgtaatgtatgctaaagtttgggaacagctgccctagagaactcttgcacaaggcataaagaagcccatgcaaaaatgctcataacagtattatttataatagtagaaaaagcaaaataacctacatattcctctgcaggaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtgggccactgttgctcaaatccttgctggtttctcctcatctcccatatctcttaatgatggcatgccccaaggctcagtctgcaccttttctgttctcttctctccatctttgctcacttgcttggtgataacatctaatctcatggttttaatcacatttctacagtgttgaatgcaggggatggaatttatcacccttgttcataccactactatctcccacctggattatggtaatagcctcctcattggcctccctgcttttgttcttaccccccttcagtctattctaaatataatattgtagcgattttaagacgttttacaatcacatcgtgtcacttctttgctcaaaagcttttatcagcatcccatctcactcagagaaagagccaaattatttataatggccttaaggtctgttatctttctgcctgtacctcctgctactctcccccttcctccctccttctgttccggccacactggcctccttcgtgtttatagagcacacctgacacgctctgctctgggagcatttatacctggggttggctttctcttggaaaacttccccaagtgacctgcctggtttatgctcccatttccttcaaatctttattcaaaggccaggccacctccttagggaggcatcctgccttccctctggccagttggccagtctgccgtgggtcctccatactggccgttgttcctacaggactctggtcagaggacagccggaaggctgtggctgctcactaccagctggcacatcttcttagagccgccctcgtgtggccactgttaggaatggcagtttctgcccgacttcggtctgagagagaaatgaacagaaagacgaaagacaagcagatggcgggatttttttatttatacattaatttacataaccaagtaagttgttaaatattttgaatgtcacttcttactgtataaatattcattatcacgaaactaccattgctttcttaaggccctaaatgccaacttgagaactaagttgcatatgttatatgggaacttatgatatttgagttattaattataactaatacttataataatttattattaattataatcacatttaggacattctattgggaaatagaaattgtttagattattcacttaaaaacgttttattgtctaatatttggtacatgcaaaagaacatgtaacattttggcacatataagttataaagaatatatgaaaacatgacgaaattaatatgtgcctacgacgccctcaccccatcaggaaccatccctccctctcaccacagaagtaacactcttctgatttgagggtttatcatttttgttttgtttttttaaaataaaactttatttatataggtatccctaaagaatatgttgtttatttttacttgtttcttagtataataaaaatggtatcttactgtatgcaatcttaaacaactgcgatttttcagtcaacatgtttttaggatttgttcgtgtagcatgtggtggtaggttgttttcatgttcactgctgtataatatttcatgactgtacccccagattgtttattcttctgttgtccagcctatgagtccccacacccaggtttttgcttatgaacagtgctgctctgcatattcttgtgaatgtctcttggaacaagtgtctgagggtatacatccaggagtggaattattggctgataggaagaagttatctaccagataatatcaaatgttttccaaagctggtgttccaaagtacagaagtgtttctgttgttcctcattttcatcaactcttggcattggtagatttaattttcaccagtctagcgagtgtaagagatcagctctgatgcaagaaaagccgacgtttccgcattcactttaaaatgtcactgaaggcttactgctccttggggtacttaagtgtgtctaataatagttccatctccagggttcacccctgctcagcctttttcttgcctgggaagggctaatcctatcagaggtttactgaggaagaaaccatttcagggtaacccaatggtttcatgaaagctcatgggcagagggttttttttaaaatgaacaatttgaaacagtattttaattaagagattcaagctgtttctgttttcctaatgaccagtgcttgctctcattgtaaattacattcccaggcaagatgacaaggaatcctttgggtgacttttttttcccctctctcctttctgattttctggactacaaattaagacaggtggagtttcttcttacacacttccccaccgggtttcctgggacttcccccaccctacaactgccttctttttgcttcgctgaagaagtgaaaaattgaggtgattctctaaaatgaacatctttattgattaggggctgattctgacagcatgtggccatctgtttaattgggttttacatctaagatgtaactatacttagtaacgtgatttatgacaatttcattcagttcccattatcattttctgatttatgctacttaaatcttcttctgcacgcaatagagacttgaatagaaaacagaaaaacctgtagttgttttttctttttcaaatccatgcctttgtgtggaaccctatgatttgtggccatctttcaatgttagatttttacagggtggttacaacttcttatttttcttcccttgtcaagctgggtagcaacgtctctagacatggcatgtagtgtgaaattataatgatttaaatctgctgtatgaggagttaaactcagtagctgtcataaaatttaattatatttgaataaggtggttaaagaggaaaacacaaatctgaaatgattggtgcttaaccctaactttgtgataactgcgacactgatcttgctgcttttcagagtggcaaggtgagaacatgaatcagagatctagtttgtatggccttagtcgaggtttttatccttccagacccctattgtcctgtctgccacatgttgaggctatctagcccatagggttttaggggaagatttaatgagacgaatttgtaaagtgccagcacattgccaagctcagggcttgtatatctaaacctggcatgccaggaatccctgcgataaccattgtgtcacaagacaaacagcaaaatataaagatcggcaggggggattatttcaaacttttgccctcaagagatcttaggccgggcatggtggctcacgcctgtaatcccagcactttgggaggctgaggcaggcggatcacctgaggttgggagttcgagaccagcctggccgacgtggtgaaacctcatctctaccaaaaatataaaaaattagccaggcttggtggcaggcgcctgtaatcctagctgctcgggaggctgaggcaggagaatcacttgaacccaaaaggcggaggttgcagtgagccgagattgtgccagtgcactacagcctgggcgacagagtgagactctgtctcaaaaaaaaaaaaagagattttattataatgttccacattataatatgtatgcatgcaactgactaaatgctgagtaaaagaagccaggtgtaagactaaatactgttctgtttcatgtgtataaagttcaggaacaggcaaatacatctatatgatagaagttaaaataatgactacctttgttgggggtattgactgagaggaggcatgtgacacattctttatcttgatctcagatgtggttacacaggtgatacaagagtaaaaactcaccgtgttctatcattaaaatttgtgtctggctgggtgtggtggctcacgcttgtaatcccagcactttgggaggccagggtgggaggattgctttaacccaggagttcgagactagcctgggccatatagcaagaccctgtgtctacaaaaaacaacaaaaaattagccaggtgtggtggcatgcacttgtagtcccagctactctggaggctaaggtgggaggattgcttgagcccaggggtttgagacagcagtgagctatgattatgccactgtactccagcctgggtgacagagcaagatcctgtctttaacaacaacaaaaatgtatgcttttactgtatgttaagtgacacctcaaaataaataggaacactgctccttttctccataaaaatgtttggaacagcgtatagtatgcatggacatctggagctaataataggttgcctcaggctaagtctctagatgtgtagaccagggattggcaaactatttctgtaaattgccagatagtaatatttttggctttgcaagtcatagtgtctttgttgcaatttctcaactctgccatggcagccatagacagttcataaaccaatgaacctggctgtgttccagtaaaactttatttacaaaacaggtggcaatattcaggtagtggtagtggtgggaagagtgaacagctcatatttggttttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatgggggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctcatccaaatttctcactacctaaaagagatcctgacactcagagcaattcttagtaattttttttccacttattcacttgattttcaagtgaattttcaaggccccaatgattttcacttcccggtattcattcccctgtctagtcccctgccacactgagtaaggcttaccactgtaactaataggatgctatggaaattctagattatgacttctgaggctgggtcataaaaaacattgtggcttttgttttttggataatgttcactctgggggaagccaaccaccacactgtgagggcattcagggagctcacacagagatccacatgtgaaggaactggggccccctgctcattaggagtaccatgtgagtgcgccatcttggaagtagatccccagtgcagccaagctttcagatgaccgtggcccaggctgacatcttggctgcaacctcacgagacactgatacagaaccacccaaataagctgtttccaaactcctgacccagagaaatggggagatagcaactatgtctggggatgatttgttacacagcaagaggtaactaatatagctattagagcatgcccaggtactaactgagtttggtaggagggtatataactttgtgtggtttagtggttaagggtgtgagctctgaagtatgacagtttgattttgaatcctggcttggccactaataacttgcaaccttgggcaagttacttaacatctttaagcctcagtttaattatctgtaaaatggagctaatagtagtaaccatcctatagggtttttgtgaagattaaatgatactatatatttaatatctaatgttatctagtacattttataatctaatattagatacataatattaatatgtaatattaaatattaattatatctaatattaatatacatttatagttatatattataaattatacatataatatattatataatatttatataatatatatcaatatgtaatatataagtatatattaaattatatatacttatatatatgttaatattgtatatataatatcatttaatcttaaccctataggatggttactactattatatatatatataaaatgcttggtatagagtgtggttcatagtaggcacccaataaacattagctattagtccttgcttttgaggagctgggagagagagacttgttaccaggtcatttagaagacatcatggtgagtgtgcaacagaagggtgtgcagtgcattctgggagccacagtggaggggcaattaagcctgggggagtcaagattggattccctatgaaactgatgtttgagtggactttggaaagaaaaagaaatttctctgggcacagaagtgagattagggcatttaggaagaagcactgttgtttggtgcaaaggcgcagatatggcagaacatagcacaggaacagactgtgagatggccacaaatgctggggcacagcttgcactggtggaagagacagcaaagggagtgatgggagatgataagtggaaggaaggctttgtgggtcatgtcaaagaacaggccagagggagctagtatagtttttttgcggggaggcaaataacttaagttttacttctgtattggtctgttttcacactgctagtaaagacgtacccaagactgggtaatttataaaggaaagaggtttaatggactcacagttccacatggctgggaggcctcacaattatggcggacggcgaaggagcagcaaaggcatgtcttacatggtggcaggcaagagagtgtatgcaggggaactcccatttataaaaccatcagatctcatgagacttattcactatcatgagaacagcatgggaacaacctgcccctatgatttaattacctcccactgggtccctcctacaacatgtgggaattatgggagctacaattcaagatgagctttgggtgggaacacagcctaaccatatcaacttccttaatcctagtattaaagatcatggtctggagagggacagattgcagccactaagaccagttaggagttttgcaaatggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaaatgccagaagtaaacagttcctaagttttaagtcgtgtgccattctgagtagcatgatgaaatctcttgctgtccagctctgtgccacctgggacgtgaatcatctctttgtccagtgtatccatgttgtatatgctacttgcctgttagtcacttagtagctgtctcagttaccagatcaactgtcacagtgcttgtgcccaagtaacccttatgttacttaataatggccccaaagcataagagtagtgatgctggcaattcaggtatgccaaagagaagcttcctttcagtgctaaggtgaaagttctccacttaaggaaatttaaaaagaaatcatatactgaggttgctaagatctacagtaagaacgaatcttctatacatgaagttgtggaggaaaaagaaatttgtgcattgtgtgcgtgtgtgtattagtttggtactatctgaggtttcaggtgtccaccaggggtcttggaacatatctcccaaggacaagagcggggactactgtacttttctaacttttccactagggctttacaggacttccatcaaatggagattataactgttctgtgcagctaggctttgctgaggaaccattaatatgccaaccattatgccaggtactttaatgtatgttatctctaatcttcacaacagttctataaacttggtattatgggctcattttacagaagaagaaactgaagctcagagaggtgatgcaacttgcaaaagactgcaaaactagcaaattgcagagctgggagtataacccagcttatctgattgcatcctgtttatcgtcacactacactgttcaaaactggataggaaatgtgagaattacagtcacgtgataggctgggtgcagtggctcacgcctgtaatcccagcactttgggaggctgaggtgggtggatcacttgaggccaggagtttaagaccagcctggccaacgtggtgaaaccctgtctctactgaaactacaaaaattagctgagcatggtggctggtgcctgtaatcccagctactcgggaggctgaggcacgagaatcacttgaacccgggaggcggaggttgcagtgagctgagatcgtgccactgtactccagtctgggtgacagagtgagactctgtctcaaaaataaaaataaaaaataaaataaaaaatagccatgagatgatatacaggaacacactctgaaaaggttaagggtatgatataaatgtgttagagtaatcattattatatcaccccctcacccatgctgctcgttcactggttgggggattgtttctcttctggtatggaaacaagatattatagaatgtaaggcagccaggaggtgagagtgagaagtttagatggtccccaagtcctactgatttcatgtccaaaagggttgtggcatcaagcagttcattattgcctcttctaacgatgctgttctctgcaagctttttggccaagcctgtgatctccttgggtctttagcttatgggaagagtggaggaggggttattctgtaagctagcttaaaaggagtatttagatatactcccccaaaaggctttactttccaaagtttacactgagattttaaaagttttgttaagtgagctgaagttaagtcatgaacaaactttgaatagtttgtgaaattgacagatgatgcacttagcaagtctgtggaacacctgctacaacttttttgtttttgttgttgtgacagagtctcactctgtcacccaggctggagtgcagtggcccgatcttggcttactgcaaccttcacctcctgggttcaagcgattcccctgcctcagcctcctgagcagctgggactacaggcgctcaccaccacgcctggctatttttttaaaatatatatttttattagagacaggagtttgccatgttggccaggctggtctcgaactcttgacctcaagtgatccacctgcctcggcctcccaaagttctgcgattacaggtgtgagccaccatgcccagacctgctacaccgattttaaggcattcttgtcctggtctagttgaggaatttggaggtcctgatacagacccccagtttctgaagcctaaccaaggaggcacctgagaatggtgttctgggtagtatcctgggaggacaaaactagcttcatctggaatgctctgcagtctcatgggattcctgttaccatggtaagtcccagaaccaatgcctgtaaggatgcaatttgccgcttgcagggtatttctaaatgctgttttcagacatagtgcactggtcaggttggctgcagggctggtagtaggaaagcatgaaatgattatcagagtcaacctgattaaagacaggatgtaagcaagccagggtgaggtgagcatagggacctaaaaaccagccatgggaacaggagacaggatgtcagggagaaatctcattaattgaccttgatggtcacagtctcatttgtcttctctttaaaaaatcaattgttttttacccttatttacaaaaggagttcatatttattgtagaaaatctagaaaaattttaagtgaactaaaaatttaaaaagttaatatcatttaaagatagtcatggttaatacctttgttgaataccactgagatgtatgtttatctacaaatattttacagtttaaattaactagactcatccaacagtactactttttccccactgaacattgtaacatgaatattttttccatttattacatattcttccaagtcatcgagtgtagtgttcaattgagaaaacaccttaatttatttaattacttcccaatggacatttaggctgtttccctattgttaaagaaccctctgtattaataagttttgtggctttctgtctaaatctgagaccatttctttagagtaaattcctagaagtggaggagttgctgtatcaaatggtatgccccatttgagggttttgaaatgcatcttacccaacttctctcaagaaagcagtacaaatttgtatttccagtaacaacaaatgagatggtttaacctttaatgagttgcatcttaaagatactgttggaggaaatgaatagagagactcagttttttgtctaactgatatagggaaaatatcagtcacatttcattcttgagaccattattgcataaccagatatggttcagtgaacccacataagcatttgttgagtacctaccatgctcccaggcctgggctgaatatccctgctgctagtgtcagtttcaaatacttagtacagcaatcaataaatgagaggacctgttggaatatgagtagaatatgagacaccgagctttatagtggaaggaaattagtgttttctttgccagatgttaaactatagcagtggttctcaaagtgcggtccctggatcatcagcatcgcttgtgatagatggggattatctggccctacctcctgaatcagagactctgggatttgggcccagcaatttatgttttaacaaggtcttaaccaccaaacttctgcaagatgccaaagattgaggaccgctgagctataaaaaggcagcaaatgcagaagaggtcagacttgttgggtaaaggtggggtgactaacttctcctggtttgcctgggaccatcccagttttagcacagaaagtctcgcatcccaggagccccttctgtcccagctagacagggatggttggtcaccctggtaaagggtggcaggggtgaagggaggttctctttgttgcagcctaaaggtaattatggcagaaaaagaatagaagggccagcagagaaggtttcaagatggagggcagatttcagaagctgctttctgcttgtcagctctaggctgatagatgtggtggcaggaggttacctgcaggaagccagcagatggctaaggcatcttgctgaatcccttgacaggagtcacagctgttagaacttgatactttctggaaaggggaaggttggcattcaccaaactactgcaagatgccaacttgaaaaaaaagccatgattaatcttagcagtgatgacaatgaaatcattttacagcaaaaaccataaccaaaagtgctttgtaattgcagcaatttccatgtcctgactgatggccccctagattctagaatggtgtcgggcttatctgattacaagaactaatcctgaataagatgtaacattcattcttagagtaagcattcatcccggattttctaaagcaggtgcaatttaaactctttttgttctttactacagtcaataatgtataaggcatgtaaagtttcagttttgaaagtatagtgtgcaaaattttaataaaagtaatcatacgttacattgttacatgcatggtgttgatgacagaaagacaggagggctgatttatagatcagttaaacataagaaattccttatttttcctaaaccaacaattctgaacctgttttcatagtcgaatcacctggggagcttttaaaaaatgcttatgttcagggttccatcccagagatggtgacttaataggtttgaggcaggggcttggacatagatattaaacaagcaaaattccccaggtgatgtgcatttggggttgagaatactgtacttaccctgatataaaccaatgggtcccaactttagcatgtaccagaatagcctgaagtgctattcagtaggtctagggaggtgggggtgcaaacatttgcacctctaaggagtgccctggtgatgctgatgctgctggtttgcagaccaagatttgatcaccagtttcctaaaccattcctactccaaaccccagataatcgtacaaaccacatctgtcacccattagctagacatgtgaataaataactccctctcaaaacacttctgcacatctactcccacgtatccagtatttcttttctctactgagtttaaaacatatttcaattaaaaagcatactttagaaagcttggtataggtttaccttcctctttaggtcttgcaaaataggattatttgtcgagtggtatcctttctccctcactagattgtaggttctctgaggacatttgtttgttcgaaggttgcccatgtggcttaggacatcataggtgctcagtaaatgttagtagtcagtggttatgcatagaaattgcatcatcataaccaaacccacctattcccagtagtttttataatgggatctaaatagactgacactccaaaattaggatcataaaacgtattcacttagagaagtcgaagctattgcacaggacaagtaaaataatcaaagaagttagcagaaggtaactacaagggaatttcaccaagaaggacaataatgtagataagatgatatatcagcaatagccctgaaatgtggactgatacatagagtagtttagtaatataagcacacacttaaggcttttgaaaaaaaaataactgtcacaacttgtactggagccacattaatacatcaaaaaatccatgcaaatgaccaaatatcccattgtttgacaaaactaataatgcaacagaatgtattgacatagtccaccccttaacaaaactatcacaaacatccacactgaaagaaaacagacacaggtacacacttaatgaaaaaacccaagtatatttctggagaaagcagctacagcaaatatggaaacagatttagttcaataaacagctgaatgtgtatgctggtccacacatcctcaagcccattgaattttcctttggaattttcccttggtcacctttttttggattgaatttactttgtcatttgcccctggctctgtcacttctgtccagaggctgctgcagggatcctaaatgaacaaattcaatgatgcttattccttcagaggagtcaaaagagatgttgaatttaagaatgaaatgctcctgaaggtagatgagttcaagttgtcttgcattgtgttactacacttacaaaagtttgctatagagaaaggagaaaagcacatggtctgggtttctgaagactggcagtgaaagttggaggcttcctattttgtaaaatctgaccaaacatggaaataacaggaaaagatgtctgagtctggttcatagttgtctaaaatcatcagcatttataagttattaacacatcaatattaaaaattaatattaaattattaatttattaatactttattaatattaaattattattattaatatttaaaaaacttccaaataacatacaattttggaaggtaatgttttaaaaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaaaaggaagaatattccacttttattgggggtcagcagggagggctaagaggatacaggagtgatggtatttgcataaaactggctggactatttagcttgttaatatctgtattgtgattgaaagtttattggaaaaatgtgctgatctcaaaactacactagttcggcaatgatagcaagagaatggaaccaacaaattctttcatctagaaggaaaatgaaaaccagaacttgaataatgggatgtatcttagatctggtactgaatgtggaaaattcaagaagtaatacattggtactactaatagtatcatgtaaggttttaaactttgtctaacaagatgtactcataatgataggtaatgcttcaaccccagtcatccctctgagtttcacaagatacagaatcagttaattcaacaagtatttattgagtgcttaccatgaaccaggtattgttctagctctgaagacatcaccattaaagaatagtaaaaaataaaaatcccttttgtcatggaacttgcattctagttggggaaagacagaaaacgcatacaaaataagtcaaatgtaaactgtcttagatggtggtaagtgttacgatgagttacaaagcaagaaagtgggtagaataacatcctgccccttaaaaaagcactagggaaggggttaatgaaaagatgatcttagcctacatacctgaagcgagccatacagatagtggcggaaagtaggttctaggttaggagaagagaggcgtagggcaaaaggaaaattattccctttttgcatgtccttctatacagtgtgaatttgctaggcctgaatatatttatttatttgttttcttgaggtctgagctgtggaataatgtgctaaatttgttttcttctctatacttgtttgtactaaaaaaaactctaattaatgcagcttacaataatgtgtactgaaacccagacacattgaggcatttaacttttctgggaaagctgtagctaccgtcagggtatgatttatgactataaaagtcaaatagttgagcctggggtaatcacccactgaatgtgattggttctttggcaattgtgtcctaaacaaaagcactctgtcttttatggtcagcattttgctaagctccaactaggttactccatatttactgataggagaattgtaatgagaaacaccagtaaaaaggagaggttgaccccagtagaaaaccaaaagcaggttcttgtggctttcccaggtgcagatttgaaaaagacagtattactgataaataattaggttattacaaagaccaatattttcttttgtcagaattttaatcattgaagtggtataaccacaatttgtatttttgcctgaaataggagtggaatttgctggtgttaacaaatgcaagaacaaaataatactatataagcttagttaactgtttttcaatagcctttagaagaattttctgtaatacacacacacttctttttttttgagatgctaaaagaaattttaataattgttacataacatactgtgtagctatttgatgaaatctacctctgtgtaataattattaaagtaagtcttgaaatgtatgataagaatatattagttttttgggtacaatttccatgaaaaaaataagaaaacaaataaataactaaaataagaaataggaggttttttatacatactgttgtcatcatacaaaattactctattaactaaatttacctgacattgtcaccgttaaaagcaaaatcaagacaaaactaattctcaaatttatttaattttagtaatatattttatttaaccctatatacccaaaatattttcattctaatatgtaatcaatatacaaaaattattaaagagatgttttatgttcttttttcatactaaggcttgaaaatccagggggtattttatttatttttatttagtgtactttaagttctagggtacatgtgcacaatgtgcaggtttgttacataggtatacatgtgccgtgttggtttgctgcacccatcaactcgtcatttacatttggtatttctcctaatgctatccctcccctagccccccaccccccgacaggcccctgtgtacacacacacttatttctaaaagaattaattttaattacacaagtttattatctttggataatcaaaaggtaaaacattacgtttatgtgtagagccctttttacgagccaccaccccaaatcctgattttcttcaaaaggtaaccactgtgatcactttgataggtattttacagacttttaaggaatttacatatgtatacacatatacacacaatacatgtatatgctcacactggtaggatagttatgtaagaagataaatggtatttatatgtctatatctgtaccttgctttatgccaacaacatgtcttggggattatttcccatgctggaattttaagacctacctctttcttttcacttactgcatagcagtccacaatatggttataccataattaattggcctcttatttggacatttagcttgttgcacacttctcaactacaagccatgcagcaatgaattctgtagtgcacttgtgcaagtgatcaggcagtggttctcacggtggcacccagaccagccgcatctgcatcgcctgagaacttgctagatgcaaattcttagccctaccctagacttattgactcataaactgaggatggggcccagcaatctgtagtttaacaagccctctggtgaatctgatgcattatacaatttgaaaaccactggcaggtatgtctgtttctacagacacacatgtacggatacagtcagttctataatgtaacatatgtgttcttaaacaccactgtgctatgcaaaagtatgtaataaaaggcctcggggcttttgagaaaaatgaggttggggcacaacagttaaaaacttcatcagtgacacgttaaaaacaaaagctgggagaccaataaaaatgatagtgcggttttatacatgttaaatgggtaaatacacaaacgctacagtaaatatggcaccttcccttgaaaagaccagaagtttgcttgtgtaagttggtattggaggggttgacccttgtgagtttttgggtagtggcggaaggagggttacatgaaattggaaggtaagttttaacagcagatgtggtgagtgtggctcctgccgcacgtggtgaactgaggcagttggtcatgttgaggtgtgtgtgtgtgtgcattttgggtattcctatatggctcagtccatttgggtgcatttttctgcttttccctagcatttcttgtggataagcaaatgcgaaattggagttatgtccaaattttcccccagtgtatcaatttccttggaataaatttgccttttcgatacaggtgtcacagctgtatgtatggatgcttattcttttgcgtacattacacaaaataactccatacactgtactgaatgctgtttttcacttaatatttcttagagctttttccatatcgccacatagttactcgtttttttttttaatggcatttaaagcattaagagatgactaaattgatctccaaaatgcttgcaacaacctacactcccatcaacatgcttcctacaccttggccaatattacctattatcacatttattaacttttgccaaccactagttaaacgtctctctccttcctctccctccctctcctccctctcctccctctccctctcttccctctgctccctctgctccctctgctccctctgctccctctcctccctctcctccctctcctccctctcctccctctctctctccctctccctctccctctcctccctctgtctcctcccccacctccacagagacatttacactgtgaggaatgcctcccgtaagtacactgatagaaaaaggaactttaaaagtgtgaaacaggtggcgaggtggtgttgaaatggtaaaaaaaaaaaaaaataaataaataaaaataaaaaggaaataaaatggatatgaaagaatacataaaaacctattaaaaaggcagaaaaaaggaattccctttctgcttatttttcacttctacctttgctaaatacaacttatccactttatgagataagatattgagttgaccctgtaggattccatctatcactctagctggttgacatctccaaaaatgcagcttacactattaatccattcacttcagcaaaacatgcctaagggcatcagattcttctgtttatcagtattgggttccttggccccaacaagctcagcagatacagctgaacagagtgatgtgtggtggcttcaactcttgagtctggggcttctaacggcaaaagtgacagacatagaggctcatgcaggtgtcagatgttttcctgtaaagaggttggcaatggacgtaaatgcttccagctgggcacattaccaggcaggataagccataatgatttaataatgaaatcacattggtttatgatcattgttcttattaggaaatatcattgctttttgatgatttattatgtgaaactgagttttcatataaacactgtgatttgcatttatttgtaatatatatttgcatatgtatatatatctgagtgagaatgacttactaaaagtaatcaccaaaaaaagaggatggaatattgatgtaaatatgccacaaatatttaaggaaatgtagaaattatgaagattattatgatgttgccacttcaaaataatattagatgcattttcctttatgtgaaactgacagagaactagtagctggatccatctctgttttgcaattaggcttttgcacctaatcacaaactacgatattattaataaaatataaagaatatatataagggttatatagaaccaccatttcccttctaaattaaggacttgctttcctgtcctcatttctcctcatgtgttctgacatggaggagagagagaaaaaaaaaagttaagaagagggaggaagaacattttgacttatgaaagagctttcagtctcatggggcctggaacagttgctctggagcagtgaaggacactacagaaggcttctctctctctttttggttatgattctttgctctatcagctgtgatgacttgtaagtacagttcctaggatcaacccagggtgcaaaatttagtggtgagttgcaagggcaaagcaaagcatgtctcccactcatctgcactcaatgtcaggtacataatttgggaagcccagtgcaaaataaaaatgtggggtctcttgttccaaaagcaggaaaaaatgccattgagggggctaaaatataaagccttgccctatctttcatgggctttctctttcaacttgtcatggtattgttttatttgctattcagtgctactataagaaaaattaaagacgtaagtcattagcctgagtgttacttttcatctcaatattgtgcaatgtcagttttaaatgcaaacataagagcatttaacttggatgtggaatcaccaaaattacatagtttgtattttgtagcttgtatgtgcgtatgtattttgttcttaccagcatggaggaaatgctgaacaaaactcaactgtttttattttacttcttaatacatgtacattctaccaatactctctacctttggtttactgatgaataaagaaggactaaaaggaaaagaatctataggttattgtataagtctgttctcacactgctaataaagacatacctgagactgggtaatttataaaggtaagaggtttaatggacttacagttccacatggctgaggaggcctcacaattatcgtggaagataaaagaggagcaaagtcatgttttacatggcggcaggcaagagagcttgtacaggggaactcccctttataaaaccattggatctcatgagacttattcactaccatgagaacagtatgggggaaaccgcgcccatgattcaattatctccacctggccccacccttgacacatggggactattacaattcaaggtgagatttgagtggggacacagccaaaccatataattcaccctttctctgtccttttctgtcatcgttttcagtgtaggtgtttggccaatacagggaagtaacaggtataagaaaggttatgacaggattccttggtcattcatgtttcttagaatgccactaccttcttttggtggttgaagcaaattctggtttgaatggaaagtatggcctcttagggctatcagagcttactcagttctagatgtatcgtatttaccttgtatttgtttggcatctcgctgaactcccatgcactatgggcctgatggagtcctgtgctcctggggcattgtgaatgctgtgtgtaaatggggctcctaggaacaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccaatagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcattgaatcaatctctctatatctcttaacattttttccttctcataggatttccagcaggagagctccagaagcctttcttttggggaacagaatatcctcggtgagtaaatgagtacagaaaccagttactgaccaattaggaagaacatgttgctttggtagaggacagaagaaacaaagtcaaaggttattcagcagaaagaagccatggaatctggcgtgggtcgcctgtactcttatcattttaggtatttgttttctgatccttgttaccagggtgtatggctggacaggaaagccatcttacacataggtggctttcatttttatgcatttattctcttacccattaactcatactaccagtatttggacattgaaggattgttgggatttgaattgatgggatgagtctaaaaccattccaggtagaagaaacagtgtgagataaggagggaaaagtgcttctataatggcagagtgtagtttggctagcccaaatggtatatgaaaggaagtagtggaaaagaagattgaggtttgatattggagggctctgcatggcaaataaggagcttggatactaataggcaatagaaaatattgaactttttgagcaagttagtaagataatcgaatttatctttagaaatataacctgtgtagctacagaataagtcaaaattggtagtgtatggacttagggataccagtttaaaggtcattttaataccaacagattgtagactcatgtaattcagaatttccatacatagtagagattctgataatatttgatgtcaataatatcaccatttctattatatactttttacttttgtgttttaatgcttggaaaattttagtcttgattctatacattgagtctcttgtgttttggtttggatatatgacaatttaaaaatatgtaggtttaaaagatacagattcccataaatatatcaataagagaaatatgttggcaatgttttcatttggcctttgggctttcccggtagcagaccttgtggtaagtattcaagtgcaattagttctttcgggaggtggtacaaggaaacaccagtaggggagtggagaattgagacagtgagggaaataagccaaatgaattatgtcctgtgagtcttttatggctgccaaaatgaattactacaaacttagtggcttaaaatgacataaacttataagcttatagttctgtaggtcagaagtccaaactggttctcactgggctaaaatcaagttgtcagcagggctactttcctttctggaagctctagagatgaatctgttttcttgccttttctagtttctagagggggcccacattccttggcttatgacctcttcctccatctttaaagttccatagtcacatctccttctgactctcatcttctgtctctcccttctacttataaggacccttgtgattacactggtaccattcagataattcaggataatcttcctgttttaagttcaactgattagcaaccttaattccgtctgcagcccctttactgtgtaacataacatattcacaggttccaaagattagcaatatggacatcttttgtaggccattattccacctaccacatgtgtgttacaaagccagttatcaccatgggcaactggagctcagtcttgctggggaactgtaaaacatgcttcagagtgatcccatctcagggacatgggagctggggtatttatctgtcctccaactcaccttccatcattgattgagggctcctaccaggggtacctggcagtgcccatcctaggccaagagggctctagtggctggagaaagtcttcaggcaactagtttcaggtgctgacatttgaaggctgtcagattggtgtgctcaaaaatagtgagggctacgaggacgtgggcagccatcgataaagcttactacagggaagcaccatcgttagagtaaataaaaattgcaggttcttatttaaccaaatccattaataatatcccaggcctcagctccatagttttctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttattgatgaagtaatttgtttattgggtctgtgagcatgttagtgtctatttgtttgtaccttaggctaggtcatagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgctcacagtggtcagcttagtcctcacctgagtgttgagtctaattatggggcatgaacaagctgaattgtttccagaagagagaatcaggactgtaaatggttgaagacaacgtttcccaaagtgtgtgttccatgaaatagtaatagaggtaagacatcctcccctcccttcagttttggggaatcataataattatcaccataaaaatttcctagaagctctccaagaaagaaacctatttagatgtgtttaacacaactaccttttttgtacccattaaccatccccacttctgaccccagccccccaccacccttcccaggctctggtaaccatccttcgaaatgcagaggttcccaaactccccggtgttttgggaaatgctgatctagaattcatgactgaagaataagagttgaaagaacttaataacacttgaagtggaacctcataactgtctgcatatttttgaaggaaagttaaggtggtagaacgacttattatattcaggagattcagcaagtgttcagttagaggctacactagaccaatagatgggagccatagaaaagacatttcagatcagcattatggagagctattacgtttagacccgcccaaagaggaaatgggttaccttagaaggggatgagctcttggtcattggaaatacccaagcagggtattataaccatttgaatgggtttttctagagggggcccattcctctagtaggaagttggagtagatgacctctaagccatttccaactcagaaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttatttatttatttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtgagccaccacgcctggccaatgacatgctaatttaaatactcttcattgataaaatagaggacatgaatctaatattatgaaatattattattgtcaggcttagtcatataaaattactttttctttgtctcttgtccaaaggattgtgattaagtaactgagaattgaaacttaaaatgattcaatcattttctgaattctctattgccttttgcaaataggaagcttgttggagcagccctgcttaaaggacatttattgcacagcaatttctataagctcccattgttcatgccttcaattcatccagtcaacagcattgactgagggatgtagaggaccaagtacttattctcagagctgagagacctggaaaaactaaatgttgcaatctgcacactgatagctactgccgcaaaaattaacactatgtaaaattacaaatttgtcccacactgctatgatagctctatgattgaaatgaataatttcactcttacttctttaatgaaggtttgcaatgatggaaaaacagtaggaagcattttttcaaatgcaaattaccttacaggaaagaaataacaaaggaaagcattgccaccaaggggaaaaattaaatcttacaccacttccttgggtgtagttgagacaaacagttagcatggtaaggatcatttatgtcctgtaataacatattactttaaaaatttccattccttccagttatgggtcctatctatttgctgggtgactttgatgttgcatgtcaggaactaactgtgagatatttttagcataattgcaaatctcatgaagaatcttcacaataaggattctaagtggtgtgtaattctcatccacaggttgaatgactaaattaagatacatacagatctgtcacttgcatgagatggtaaagttaactaatcagttaaatcattgttactttcttacgctgtacaaggcatagaggatgtagcaatgaacaagtagataagagagtggcctcaatagaacttacatttgagagagaaaatcccagacatacatatggaaaccccattattgatttcttcatatattcttaatatgctttgctatgtaacaaagcaccaccaagcaaccatttattagctcatgattctgtaatttgggcaggactgagctgagacagctgctctgtatggtgctggccggggtcgctcaactagggctggactcacagacaggtgagtgaaggcgacctcactcacctgtctgtgccccagttgggctggctctcgtggctggggcatggcagggcctctctctcttcctttggagtctctcaacttctggggtttctcgcttcttcatttggcctcattccctctagctgtgtagttgaacttctttgcaagtgacttccaagaaggtggaaaatggaagctactaagtttcttaaggcctagacccagaagtcatacctgaccccttccactgcattctgttggtcatagcaagtcccaaggccagtccaaatttaagaagagggaaatagattgtctcttgatgggaggaggggctatgtgcattcaggggtagggagaattgttggtgtccccttttatagataatctaccacatgcttcttcagaggtgaagagaaataatgtggcacctttttcaaatctttgctattcagttgctatcttgtctacaacagaaagaggaacgtgactacctttgaaaatagagtgatcccttttaatctctactctattcctttttttatgactacatttggaaaacaatttaacttctaagactatagtgacttttcaacaagtttccagataaaatatacatgatatatttactgacaggatcttttcaagccctgttctaggtgttcataaatatatagctatagcagataaaaaaatcatagcaatcttaaggctgaaagggactttagaaatcatctctttcacatccctaatttcagagagtagggcactaaggttcatatgtggtaataatgacaatgtttgttagaatttatattttctttgtctatttcaattggaaggtatgtttagattttttacagctttatgggtatggttattcgattgttattaccatggttactagaaagcagtttatcttggctttccattgaaaaaattaaaggattatgctctgagattcatgcttgtaattgtctccaaattatgtattaatgccatagatctctgagttatggtgctataggagtaattgtcggacatgaatttacacatggatttgataataatggtaagtaccggttcattttataagctgctgcttttataataatgttgactatatggatgttaattgttatgattatctttgcatagcagcagcatcatagcttgaagattatccaaagcaatatgattgctgattgaaaacttttcaccgtgtcttgctgtgatggcttgcaataagtaaacaattgttcccattggtgatcggggtagactttaaaaggcagccttgtaatttcaataaaattagctttgcatttagatcaggattgctgtagctgccacaatagttacagagattgatttatagcttctccctttgtcatttattcattgtcttgagatattctccctggaggagcaagctctgctccaacgatgattatacatgctgccaagttaggactcgttgagttaggactctggagcttggctgactggttcccttttacgatttcgaagattatgcaatgcttaatctatatttttctctatactggcttatattctgattattattattattattatcattattgagacggagtctagctctgtcgccaggctggagtgcagtggcacgatctcggctcactgcaacctcggcctcccgtgttcaagtgattctcctgcctcagcctcccgagtagctgggattacgggcacgtgccactatgcccagctaatttttgtatttttaatagagacggggtttcaccacattagccaggatggtctcgatctcctgacctcgtgatctgcccacctcagcttcccaaagtgctgggattacaggcatgagctaccgcgcctggcctattctgattattttaaagtctatactttcctgataatttatataataggatatgctttgtatcccgatgacatttaagcaaaaagaaaaagcagaatatgacataaactaaagaaatggcttcctttgagagtcctcatcatcattaatcagcactcttttctcctttaactttggagtattatcggaaggccacatgaaatctctgaaacttacggattagtagcaaattactatcacatccatacccacacagtgatttacaggcagtctcaggaaccagctgccctaaggcaacgttatatagaaggggacctctttcttccatccctgtagtatctccaacatccttcctggatgcctaccccagggccagagacacttaggctcttctagaaaagtcttcctgtactcccaccagcccttccttaatcacctagattttttgctcccctggtcttcccttctctgttaaaatgtggctgacttgtagttataaatgtggctgacttgtagttatctgactctgcagagctagactttctgcctttgggtgtttggtttatctgagatgagagtcttagctaagaaaaaaaaaagctaatagtcctttcttcgttctggacctctcttgataggaaatttaagtacagttcctccccagaaccttctggagtctttctcaaaggactgaatctaatggtggcaatttcactctgtaaccaatgcttagaacagtgcattgcacatataagtacatgcccggtacctatttaatgattggttggttagtgggtagaggacagtgactccatactatcccagggggtggtgttagtagtatgtagccttgctgaagagttttggattgttccaattaacaactttacttacgggacttttttgtaagctctctgtataattaaatttaaacgatgcctctgattctcatagtaaccctgaatatagaagacagtctagcagcatccaaattttgtttcaaaggctgtagagaaaatgaagagtgagcacatagcaagaaagcatgtgtaatctttcttcccattgtgttttggagattttcattcttattccaagttttctttttagagcaatcttccctgtctaagcaggacagatgggccttccgtccacactagtggctgtggaatgaatcataacagaggttttatgtgtctttcagctcctggcaacttggaggaaacaggttcctatagggctgagtcagggtctatgatcgcacagtatggatgactcactggggctattcctatggatcatttggaatttcactggtagtaatgctctgattgcctccatgggctttctgaatgaagccattttatttcataatccagtgaacactttgggtcaaatcaggtgaagacacagaatccaagattgaataagactagtatatgtaataaattgatgaatctcatttttaaggtgctctttgttccttagaaggaaagaacttcctcaattgtctttatcctttttgccctttttacaattaacctgtgacattggagagaatgcaggagctgatctcaggaagagtgttccctgctgttatgactgctttttgaaggcttgtcgaggtgagggaaaggaaagatgaatttagtttccataaataacacaaatgtcttcgaacttttccttttgctaggtagaaaatatgataaaaatggaaacctggatccttggtggtctactgaatcagaagaaaagtttaaggaaaaaacaaaatgcatgattaaccagtatagcaactattattggaagaaagctggcttaaatgtgagtacaactgtggctaaggggggcaccttgtggttcatttttcctcatttggacattagcttgctttaaaccattggttctcaaagcgtgtttacaagatcaacagcatctgtcttccttgggaacattcttgagtcctaccccatacctgctgaatcagaatctttggggttggggcctggtcatcccttaaccaggcatgaactttttcctgatatattactagggctggaaaaatacctaaatccttgctatgcctcaaatctattatacttgtagatgaatttaggtaaaaatccatgtgcttcttttaaagggaatgtttataaacactgacttggttctcctggttcttaaaccatgctcagcccaagtgagaccactgctcattcaggcagagaaaccagagtctgtatccttgaatggtgtctagctcttttatcagtgtcctggacagccatttctctgcctatatatttttaaatatctacaactgtgacatgagaagacctaaaatgggtgcttctatgtatctctatatagtgcaggggttttcacactgtgaaaattcatctggagtatatgttgcttcaagaaaagcatagcagaaaggggttctagagtcagacatgggtccaaatctaggttcaactagttttatgaacttgggcaagttacttaatgttcctgagtctcagcatcttcatctgtgaaacgggtcaatgtttctgaactcatggatttgttgtaagaattaagtgagcaaagcaatgtggagcactagcacaaggcctgacataaagcaagtgctcaataaaagatcgttagttaatattcctgatccttcgtgacatactcattagtaccctatcccaggaaaaaacaaagccaaagatttttgggttaaaaaccccccaaaaaacaatagaacagctttcttggaggaagggaatttatatttcctgatgattagtatatacaggcatgaagatgaaacttttcacttaattgaaacaaatgtatccccatactagtcctgagaggtatagattattactaagtgtacaggttttacgtatgaggttcaaaggaattaaactgaggttcaaagagattaaaatccacggtagagtctagattagagtttaagtaagtctgtacgactccaaagtccatactgcttcccctatatcatgctgaggttcttattttaagttcattttatatctgggtgatgtgtgggtggactgctcttcaccattcattttggccaaagtgtcagagattgaaacttaattctgacaaatgtgtacctttgtcacaaggacgatagaaagggcatgcctgtcttagcaccaatccacttaaccatcagaaaacagcttcagtttcattcccacaggagagtgggtggcttcctttgtggatataagggccatgctttattatttttctggcttcatttataggagccgttcctttgtgcctgaatcttgctttgtagtgacttcgggggagctcagatggggcactacagatgcagactgtcagcagctgttgagtctttttttgttgttgttccttttcgtagctgttgagtcttgggagtccaaacctagggccacgtggtctactgaggcagaccagagttcaaggagccagaggggtgaggctgctccaaaaggctctaaattagatataaagcttagagtgaatggctgggcatggtgactcatgcctgtattctaaacactttggaaggccaaggtgggaggatcacttgaacctaggattttgataccagcctgggaaacatacggagaccctgtctctacagaaaattttttaaaaaattagccgggtgtagtggtgcatgcctgtagtcccagctactcaggaggctgaggtggaagaattgttggaaccctatagtgagatatgatcacaccactgcactccagtgtgggtgaaagagagagaccctgtctcaaaacacacaaacacacacgaaaccctcagagtaaaaaggaaggagattaaattttttaagcaggagtggatataatcataatcttcaagagccaagaggagttgggacttgagaaagtagcatattaggaagcaaaggctctggagacagaagactgcttgggttcgaatcccagtgacatgcgagcagtttacttcatcactctgtcttaggttcactagaagcagagcccaagaaggggttccttaggtcattgacttttttgagacagcgtctcgctgagtcacccaggctggagtgcggtggtgtgatctcggctcactacaacctctgcctccctggttcaagtgattctcctgcctcagcctccccagtagctgcgattacaggtgccagccaccacgcctggctgatttttgtatttttaatagatacggggtttcttcatgttggccagtctggtctcaaacccctgacctcaggcaatctgcccgccccagcctcccgaagtgctgggattacaggtgtgagccaccgcacccagcccaggtcagtgatttattcagaaagtcgtttcaggaaaaacctataatggaatgagggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgttagcagttgtgggaatgggtgcacagtttaggcagaaaaggggatctggtgggatatcgacatctgctacactctcggagctttagatcctcatttgttgagcaagggtggtggtaattagcacttacttacctcatacgactgtggataacaaagaatatacgtaaagcaggaatggtagcttttgtgtactgaagctaggagggtcctgagtgattacagtgaataatattttccaaagatttgtttttattcattgatattgcttgatacctgggtgactgggctagcttaaaagtaaagtgttggtaagatccatggcttgaaagttaaaagcaaggtatattagttttctgttgcttgctataacaagttactataaacttagtagcttcaaataacataaattatcatacagcgctgtatgatttattatcatacagctctgtatgtcagaagtctgacatggatctcagtggactaaaatcaaagtgtcagcagggccacattcctttgtagaggttctaggggagtatctgtttcctcgccttttctagcttttagaggctgcccacattccttagctcatggccccttcgtttttcaaagccagcactggccggtggagtcttctcatgttgcatcactctgacactcgctctcctgcctcccttttcctcttgtaagaacttttgtaattacactgggtccacctggacaatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccactgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataattttttttaccatgctggctggttgtcatacatatcgcagacctcgaccttgtgatctgcactacttctgtttgatttttcttccctaggagaaccactttccttttaattttccatggaaattgctgaaggtaaaatgatgatagttggtcttgaaatcttgttcctgtgtggatggtaaatttttggaaacacaggcacaatgagaagaatactcaaattatgtgagttaatcagagaaagtaacctgtgtattgacattcctgttttttcccattaaaccagagtcactcagaatattgttaacattttattggagctggctagattggttagaatgaagaggtaggtgaaaaagaagtgtgtagcataatgaaatagaaagtattacattccagagcaccttgctgaggatagtttgccatctttcttacaatatattatgcctacctctgatttattgaatgtgattttctctttaaaatatgatacttttcttgctataatattgatgcctcttgctgaatgatagttgaccgtgaaacacgcattcattttttttttttccttttttctttctgttaggtcaaggggaagaggaccctgggagaaaatattgctgataatggaggcctgcgggaagcttttagggtatgcgctgctacatttaccgtggttctaaaaatcaagccataaaacaccatatgggggtacctcaattcataccatagccatgttcttgaggagttagttagttagatattatggaatttctgtaaatagaagtgtgtctccccattgaccctattacataaagagaactatatttcttttttctttttggggtgtgaagtcaccctaaagaataatatttgttattaagaatcatgtatttaaagaatagcttttagaaaatacattcaccatcagatcgaagcatgctacagcaatctccttggggctaggttcatttgttttccttgagtacaggtctttctgtagtcctcctataaatttctcttaaaatatcaaacttctaaattatgaccagagggtagtggttctcatatactgggccaagtgatagttcataataacgttttcatcatccactagtttgtggtcaaataagaagcataaagataatacagaaagatttcataaagctaaatgcattaaatttaatgactagactgttattcctggttatatccttcctatattctagttgaaatatactttattttataaaatgagggcactagaagatgataggttttctcttacgtgtcaaaatgaaaaaaggtaatatgcggaccccaaaatgtattgccataggggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgctattcctgtgctagctgagcaaagagaaaaacccaccgttgcagagactcatctcttcttcttctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatgcaggacttgagtttgctcccttgatcaaagaaagatttcaaacaaaagtttaatggcatgactttgattttcagcaaaaatgttatcttgattattttcagggtaaatctcatcttcttaatgttctgtagtacataattaattaactgattgaatcaaggtttattagtattttttaaatcaaatgggttagcagccctgtggtaattcatttgatagttcctcaatgtatcttgacttcttaatgtgtttgatactatttatttgtaaccatttctagtaacttgctctttggctttcatgggcctgctctttcctatattgctcctcctttgcctcatttgctgactttatgccaccactctcagcctgtgggggaccctcagggtcatgttcccaactgtctaatgcatatgcagagacccctagagctgaaaaagaacaaaggcaaggagagtcatgtcactcttttgtgagtttaataggctcttggagcagaaattgaaaggaagatgtacacgaaataaagcacagttccgagcctgagtctctgtctaatgaggcaagtgccaaatctttattagctattatactggtttatgtcataaacatacgggcagccttttcaaagaagtcagggataggtcaataaaggttctagtgaatggcctcaccgtgggcaaatgtgtatgaatatgctcaaagctagacaaaaattttcatcagtacaaccttttgttcctaagtctgtctttgctttcactgctaagtaagctcattctcacacgagtcttctataattcactctggtcacaggattcttgcttgcctgcggtcttttatttcttaaagctaataaaaaacactaaataaattattatttagcaacctaatgtcaacaaaactcaactctagtcatccacaacatgactttccttttacttttcctgtttctatcatcacatcccatctttagattttcctggttagaaagcctggattcttaggtcttatttgatgcatctgtcctcaattttacaacatgtattccagaagccagatgtttcatactttactttactttaaaaaaaaattatactttaagttctggggtacacgtgcagaacgtgcagttttgttacataggtatacatgtgccatggtagtttgctgcacccatcaacccgtcacctacattaggtatttttcctaatgctatagctcttctagcccccaaccaaccctctgacaggccctggtgtgtgatgttcccctctctgtgtctatgtgttttcattgttcgactcccactcatgagtgagaacatgcggggtttggttttctgttcttgtgatagtttgctgagaatgacggtttccagattcatccatgtccctgcaaagaacatgagctcatccttttttatggctacacagtatgccatggtgtatatgtgccacattttctttatccagtctagtctatcactgatggacatttgggttggtgccaagtctttgccattgtgaatagtgccacaataaacataagtgtgcatggcatctttctttatagtagcatggtttataatcctttgggtatatacccagtaatgggatggctgggtcaaatggcatttctggttctagatccttgaggaatcgccacactgtcttccacaatggttgaactaatttacactcccaccaacagtgtaaaagtgctcctatttctctacatcctctacagcatctgttgtttcctgactttttaatgatcaccattctaacaggcatgagatggtatctcatagtggttttgatttgcatttctctaatgaccagtgatgataatgagcatttttcatatgtttgttggctgcataaatgtcttcttttgagaaatgtctgttcgtagcctttgcccactttttgatgaggttgtttttttcttgtaaatttgtataagttctttgtagattctcgatactagccctttgtcaaatggatagattgcaaaaattttctcccattctttaggatgcctcttcactctggtggtagtttctttggctgtgcagaagctctttagtttaattagattccatttgtcaattttggcttttgttgccattgcttttggtgttttggacatgaagtctttgcccatgcctatgttctgaatggtattgcccaggttttcttctaggatttttatggctttaggtcttaagtttgtttaagtctttaatctatcttgagttaatttttgtataaggtgtaaggaagggatccagtttgttttctgcatatggctagccagttttcccaacatcatttattaaatagggaatcctttccccattgcttgtttttggcaggtttgtcaaagatcagatggttgtagatgtgtggtgttatttctgagggctctgttctgttccattggtctatatatctgttttggtaccagcaccatgctgttttggatactgcagtcttgtagtaaagtttaaagtcaggtagtgtgatgcctccagctttgttctttttgcttaggattgttttggctatatgggctctttttttttttttttttttttttttttttttttggttccatatgaagtttaaagtagttttttccattctgtgaagaaagaaagtcaatggtagcttgatggggatagcaatgaatctctctctaaattactttgggcagtatggccattttcacgatattgattcttcctatccatgagcatggaatgtttttccattggtttgtgttctctcttatttccttgagcagtggtttgtagttatccttgaagaggtcctttacatcccttgtaagttgtattcctaggtggtttattctcttagtggcaattgtgaatgggagttgactcatgatttggctctctgtttgtctgtgattggtgtataggaatgcttgtgatttttgcccatcgattttgtatcctgagactttgccgaagctgcttatcagcttaaggagattttgggctgagacgatggggttttcttaatatacaatcatgtcatctgcaaacagagacagtttgacttcctcttttcctatttcaataccctttatttctttctcttgcctgactgccctggccagaacttccaatactatgttgaataggagtggtgagagagggcatccttgtctggtgctggtttccaaagggaatgcttccagtttttgcccattcagtatgatattagctgtgggtttgtcataaatagctcttccaattttgagatacgtgccatcaatacctagtttactgagagtttttagcatcaaggggtgttgaattttgtcaaaggccttttctgcatctattgagataatcatgtggtttttgtcattggttctgtttatgtttattgatttgcatatgttaaaacagccttgcatcccatgtatgaagccgacttgatcatgtgatggataagctttttgatgtgctgctggatttggtttgcaagtattttatcgggtattttcgcatagatgttcatcagggatattggcctgaaagttttctttttttttgttgtgtctctgccaggttttggtatcaggatcatgctggcctcataaaatgagttagggaggattccctcttcttctgtggtttggaatagcttcagaaggaatggtaccagctcctctttgtacctctggtagaattcggctgtgaatctgtctggtcctcaactttttttggttggtaggctatcaattgctgcctcaatttcagaacttgttattggtctattcagggattcaacttctacctggtttagtcttgggagggtgtatgcgtccaggaatttatccatttcttctagattttctagtttatttgcatagaggtgtttatagtattctctgatggtagtttgaatttctgtgggattcttggtgatatcccctttatcattttttattgcgactatttgattcttctctcccttattagtctttcttgctagtggtctatctgtgttgttgatcttttcaaaaaaccagctcctggattcattgattttttgaagggttttttgtgtctctatctccttcagttctgctctgatgttagttatttcctgttttctgctagcttttgaatttgtttgctcttgcttctctggttcttttcattgtgatgttagggtgtcaattttagatctttcctgctttctcttgtgtgcatttagtgctataaatttctctctacacactgatttaaatgtgtcccagagattctggtacattgtgtctttgttctcactggtttcaaagaacatctttatttctgccttcattttgttatgtacccagtagtcattcaggagcaggttgttcagtttccatgtagctgtgtggttttgagtgagtttcttaatcctgagttctaatttgattgcactgaggtctgagagactgtttgttatgattttctttctttcttttgcatttgctgagaagtgttttacttccaattatgtgatcaattttacaataagagcgatgaggtgctgagaatatatattctattgatttggggtggagagttctgtagatgcctattaggtccacttggtccagagctgagttcaagttctggatatccttgttaattaattttctgtccatttatctaatattgacagtggggcgtaaagtctcccacgattattgtgtcggagtctaagtctctttgtaggtctctaaggacttgcttgatgaatctgggtgttcctgtatagggtgcatatatatttaggatagttagctcttcttgttgcattgacccctttacgattatgtaatgctcttctttgtctcttttgatctttgttcatttaaagtctgttttatcagagattaggattgccacttctgcttttttttttttttttttttttttttttttgctttccatttgcttggtaaatattcctccatccctttatttattttgagcctatgtgtgtctttctttgcatgtgagatgggtttcctgaatacagcacattgatagttcttgactctatccaatttgccagtctgtgtcttttaattggggcatttagcccatttacatttaaggttaatattgttacgtgtgaatttgatcccgtcattatgctgctacctggatattttacccattagttgatgcagtttcttcatagtgttgatggtctttctttacaatttggtgtttttcagtggctggtgccagttgttcctttctgtgttcagtgcttctttgaggagctcttgtaaggaaggcctggtggtgacaaaatctctcagcctttgcttgtctgtaaaggattttatttctcctttgcttatgaagcttagtttggctggatatgaaattgtgggttgaaaattcttttcttttctttgagattgttgaatattggccctcactctctcctggcttgtagagtttgtgctgagagagatccactgtttgttagcctgatgggcatccctttgtgggtaacccgacctttctctctggctccccttaactttttttcctccatttcaaccttggtgaatctgacgattatgtgtcttggggttgctcttctcgaggagtatcttagtggtgttttctgtatttcctgaatttgactgtgggcctgtcttgctagggaggggaagttctcctggataatatcctgaagagtgttttccaacttggttccattctccccgtcactttcaggtacaccaatcaaacgtagatttggtcttttcacatagtcccatatttcttggaggctttgttcatttcatttcactccttcttctctaatcttgtcttctcgctttatttcactgagttgatcttcaatctctgatatcctttcttccgcttgatcaattcggctattgatacttgtgtatgcttcacaaagttctcatgctgtgttttttagctccatcaggtcatttgtgttctcctctaaactggttattctagctagcaattcatctaacctgttttcaaggttcttagcttccttgcattgggttagaacaatgctcctttagctcggagaagtttgttatcacccaccttctgaagcctacttctgtcaattcgtcaaaatcattctccgtccagttttgttcccttgctggcgaggtgttgtgatcctttggaggagaggaggtattttggtttttgtaacttttagcctctttgtgctggtttctccccatctttgtggatttatctacctttggtctttgatgttggtgaccttcggatggggtattttagtagacgtgctgttcctttctgtttgtttgttagttttccttcttacaaacaggctcctctgctgcaggtctgctggaggtgcactccagactctgtttacctgggtatcaccagcagaggctgcagaacagcaaaaattgctgcctgttcttccctccggaagctttgccccagaggggcacctgccagatgccagccagagctctcctgtatgagatgtttgtcggcccctaccgggaggtgtctcccagtcaggatacacgggggtcaggtacccacttgaggaggcagtctgacccttagcagagctcgaccactgcgctggctgtcaggcagggacgtttaagtctgctgaagctgtgcccacagctgccccttcccccaagtgctctgtcctagggagatgggagttttatctataattccctgactggggctgttgccttttttttttagagatgccctgcccagagaggtgacatctggcagtctggccacagtggccgtgctgagctgtggtgggctcctcccagttcaaacttcctggtggctttgtttacactgtgagggtaaaaccacctactgaagcctcagcattggggaacgccccttccccccccaagctcaagtgtcccaggtcaatctcagactgctgctgtactggcagcgagaatttcaagccagtggatcttagcttgctgggctctgtgggggtaggacccgccaagccagaccacttggctccctggctttagaaccccttctgacgggagtgaacggttctgtcttgctggcgttcccagcaccagtggggtatcaaaaaaaaaaaaaaccacacacacacacacagaaaaacaacaacaatgaaacaacaaaaaactcttgcagctagttgggtgtctgcccaaatggccacccagttttgtgctggaaacccagagccctggtggggtaggcactggagggaatctggaatctcctcctgttctgcaggttgcgaagaccgtggggaaagtgcagtatctggactggagtgcacggttcctcaggctcagtccctcatggcttcccttgggtaggggagaaaattccccgaccccttgcacttcctgggtgaggtgacaccagaccctgcttcggcttgccctctgtggcctgcacccactgtccaaccagtcccaatgagatgaactgggtacctcagttggaaatgcagaaatcacccacttactttctgcattgatttggcattgatttcgctgggagctgcagtccagtgctgttcctatttggccatcttctagttcttctcgatgtttcatacttttaagtgcttttcagatttgacatcttctctcctgttttagacagtttgggctgctataacaaagtgtcatagactaggtggcttatgaacaacagaaatttatcacagttctggaggctggaagtctgcgatcagagtgctagtgggatcgagttttggtgagggctttcttctgggttgcacactgccaatttctctctgtgtcctcacatggtggaaagagctagctagctctctggcctcttcttataagggtactaatcccattcctgagggctccaccctcatgatttaattgcctcccaaaggcccaactcctaatgccatcacattgatcagggcttcaacataagaattttgggggatagaaacatttagtccatagcatccccattaccctatcttatcatatatagttagttatcatatataggcataatcttaataaatatcctctactctggattatcccaacagccttatggaatgttaatctgacttcagcatttttttttttaaccactgttatacataccattggaataccacttttatttcattaccaacctgctgaaagaactacagtggctcccaaatgcctaccacattgaagccaaatacctccatctggcttcccaaattttcagtatgatccaactccactcaatccaattcaatttcccataactaactccactgggtgagaaaaaactcagccttagtggggcaagtatcctcacttctaccctacaatgtcatgcccattactgtctctttggctttgcttctgattctccttctataatgcaacccttcctactcttccccttcagatgattattcaatctaagcttcatccttcaggatccatgttgagttccactccctccacatcttccataaactcttccccaaggaccccagtccttattattttcttttatcttcaactccttttatctttcttactttcattaccatgcagttgagtacttaactgctctccaaatgttcaagaattttagttttatctccacagctaatcttctggatccttacacttcctatctccatagcacccagcaaagatgctgggtatattgaagacagttgatatttttagatcaattgcttgaaatgactaaaactaacagttcaactaaggagactcccttttactgggtcagatatataaaataagtatacaaaaatagaactttctagagttgggattggcaaactagggccaaatatggcctgctgcctgtttttgtaaataatgttttattggaaagcagccacattccttcatttattcatgatctgtagctggttttgtactacagtggcagagttgaataattgaaacagggaccttatagtcttcaaagcctaaaatctttaccatctgtctcttttcagaaaaagtttgctaacccctgctctagaggacaaagtatagtgatctatcaatcagttcttactatttacatcctagcccacaatatctctttgtagataaaataaactaattgattgatagtgaagttacttataattctgaaatgtttccagatataataccaaactaaactatagctgactgatttattgtaaactaaagagatagatagatagatttaggggggaaaagtggaaagctattttatatcttatatcactagtgagaaatttatcttggagcttttcccactgacagaatgaagagatttttcagtcttttgcactttaaagtaagtctgcttataaggagtaaaattactttccctcctgggaaggtactaagaaaacagtagcaggcataatgtgttttcagaagtctcttaagtgatatattaagcaaagacaatactatattagagtataagaatataggaagaaataagaaatgaggtaaaatcaaatgccagaaacaacttcatattagccagcttctgaggaaatcaagggatcgcattacaaaacatcatcttcaaagtcaaattcagaaccactgtgactggtggtttatcttcatcaaaagcaacaacatcatatcacctttcctgctttctatgtccctgtagttgctgtgacctctcatttttctcagatattcttctaatccttctacttctttccattctattttctacttatttagtggacatccattgagaaccttcctggtatctataaataatctaactagcctctaatttcttccttccactatacacccctgccagataaatctttttcaaaatctgggttttattattttcctactcaagaatgacttttaaatatagtttaaacgctctgaccaactgctcaggacttcagaaatctgacactgtccttcctctcccactgctgcccgttaggcatcatatactccagcctagctgaatgtctggttctctttcccctcaaacatgtctttgttcccatttccccctccacttagaatatttttttccatatttatgtgtcctagttcaattcacacttgaagaccatatcatacctcaagtcatatggcaagtcaggattaaagtaagtaagttatgctgcagaaacaacacgacaaagtttatttcttgttcactctccatgtccaacatgagtcagcagtggggctcttgtagtttttcatcaagaagttgggttttgggccgggcatggcctgtaatcccagcactttgggaggccgaggcgggtggattgcctgaggtgaggagttagttagtttgagaccagcctggccaacatggcaaaaccccatctctactaaaaaaatacaaaaattaggcaagatggcttaataggaacagctctggtctgcagctcccagcaggattgacacagaaggcgggtgatttctgcatttccaactgaggtacccggttcatctcactgggactggttggacagtgggtgcagcccacggagggtgagccaaagcagggtgggacgtcacttcacccgggaagcacaaggggttgggggatttcctgttcctagccaagggaagccatgagagactttaccaggaggaacagtgcactccagcccagctactgcgcatttcccacagtcttcgcaactggcagaccaggagattccttacagtaccgggctcggtgcatcccacccccatggagcccagcaagctgagatccactggcttgaaattgtcactgctagcacagcagtctgaagttgacctgggatgcttaagcttggagttgggaggggcatccgccattgctgaggcttgagtaggctgttttaccctcacagtgtaaacaaagccactgggaagtttgaactaggtagagcccacagcagttcagcaaggccactgtgaccagactgcctctctaggcagagcatctctgaaaagcagcagccccagtcagggaattataggtaaaacccccatctccctgggacagagcatctaggggaaggggcagctgtgggcacagcttcagcagacttaaacgtccctgcctgacagccagcacagcggtcgagctctgctaagggtcagactgcctcctcaagtgggtcccggacccccgtgtatcctggctgggagatacctcccagtaagggctgacaaacatctcatacaggagagctctcactagcatctggcaggtgcccctctgtggacaaagcttccagaggaaggaacaggcagcaatctttgctcttctgtgtagacttcactggtgatacctagccaaacagggtctggagaggacctccagcaaactccagcagacctacagcagaggagccctgagttagaaggaaaactgacaaacaaacagaaaggaatagtagcaacatcaacaaaaaggatgtccgatcagagaccatatccgaaggtcaccagcatcaaagaccaaaggtagataaatccacgaggatggggagaaaccagtgcaaaaaggctgaaaactccaaaacccagaacgcctcttctccttcaaaggatcacaactcctcgccagcaagggaacaaaactggacggagaaagaatgattttgatgaattgacagaagtaggcttcagaaggcgggtgacaacagactcctccgaggtaaaggagcatgttctaacccattgcaaggaagctaagaaccttgaaaacaggttagaggaactgctaactagaataaccagtttagaggagaacataaatgacttgatggagctgaaaaacacagcacgagaactttgtgaagcatacacaagtatcaatagccgaactgatcaagcggaagaaaggatatcagagattgaagatcaactcaatgaaataaagtgagaagacaagattagagaaaaaagagttaaaagaaatgaacaaagcctccaagaaatatgggactctgtgaaaagaccaaatctacatttgatgggtgtacctgaaagtgacggggagaatggaaccaagttggaaaacactcttcaggatattatccaggagaacgtccccaacctaacaaggcaggccaacattcaaattcaggaaatacagagaacaccgcaaaaatattcctcgaaaagagcaacccaagacatataatcatcagatttaccaaggttgaaatgaaggaaaaaaggttaaggggagccagagagaaaggtcgggttacccacaaagggatgcccatcagactaacaaaggatatttcggcagaaaccctacaagccagaagagagagggggcaagtattcaacaatttcaaagaaaagaattttcaacccacaatttcatatccagccaaactaagcttcataagcaaaggagaaataaaatcctttacagacaagcaaaggctgagagattttgtcaccaccaggcctgccttacaagagctccgcaaagaagcactgaacacagaaaggaacaactggtaccagccactgaaaaacaccaaattgtaaagaccatcaacactatgaagaaactgcatcaactaatgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaagggatggaggaagatctaccaagcaaatggaaagcaaaaaacaaaaacaaacaaaaaaaaaacagaggttgcaatcctagtctctgataaaacagactttaatccaacaaagatcaaaagagacaaagaaagaagagcattacataatggtaaaggggtcaatgcagcatgaagagctaactatcctaaatatatatgcacccaatacaggagtacccagattcataaagcaagttctcagagacctacaaagagacttagattcccaaacagtaacagtgggagactttaacaccccactgtcaacactactgccaacactagacagattgagacaaaattaattaacaaggatatccagggcttgaactcagctctggaccaagtggacctaacaggcatctacagaactgtccatcccaaatcaaatcaacagaatatacattcttctcagcaccacatcacacttattccaaaattgaccacatagttggaggtaaaacacttctcagcaaatgcaaaagaatgaaaatcataacaaacagtctctcagaccacagtgcaaacaaattagaactcaggattaagaaactcactcaaaactccccaactacatggaaactgaacaacctgcacctgaatgactattaggtaaataacaaaatgaaggcagaaataaagatgttctttgaaactaacgagaacaaagacacaacgtacctgaatctctgggacacatttaaagcagtgtgtagaaagaaatttataacactaaatgcccacaagagaaagcaggaaagatctaaaattgacaccctaacatcacaattaaaagtactagagaagcaagagcaaacaaattcaaaagccagcagaaaacaagaaataactaagatcagagcagaacggaaggagatagagacatgaaaaacccttcaaaacatcaatggatccaggagctggcttttcaaaaagatcaacaaaatagaccactagccagactaataaagaataaaagagggaagaatgaaatagacgcaataaaaaatgataaaggcgacatcaccaccgatcccacagaaatacagtctaccatcagagaatactataaacacctctatgcaaataaactagaaaatctagaagaaatggataaattcctgggcacatacaccctcccaagactaaaccaggcagaagttgaatccctgaatagaccaataacaagttctgaaattgaggtagcaattaatagcctactaaccaaaaaaaagttgttgaggaccagacaggttcacagccgaattcgaccagaggtacaaagaggagctggcaccattccttctgaaactattccaaacaatagaaagagagggaacccttcctaactcattttatgaggccagcgtgatcctgataccaaaacctggcagagacacaacaaaaaaagagaattttagaccaatatccctgatgaacatcaaggcaaaaatcctcagtaagatattggcaaactgaatccagtggcacatcaaaaagcttatccaccacaaccaagttggcttcatacctgggatgcaaggctggttcaacatatgcaaatcaataaacataatccatcacatacacagaaccaatgacaaaaaccacacgattatttcaatagatgcagaaaaggcatttgacaaaattcaacaccccttgatgctaaaaactctcaataaactaggtatcgatggaacgtatctcaaaataataagagctatttatgacaaacccacagccaatatcatactgattgggcaaaaactggaagcattccctttgaaaaccagcacaagacaaggatgccctctctcaccactcctattcaacatagtgttggaagttctggccagggcaatcaggcaagagaaataaagggtattcaaataggaagaaaggaagtcagattgtctctgtttgcagatgacatgatggattgtatattaagaaaaccccatcgtctcagcccaaaatctccttaagctgataagcaacttcagcaaagtctcaggatacaaaatcaatgtgcaaaaatcccaagcattcctatacaccaataacagacaaacagagagccaaatcatgagtcaactcccattcacaattgccactaagagaataaaatacctaggaatacaacttacaagggatgtgaaggacctcttcaaggagaactacaaaccactgctcaacaaaataaaaagaggacacaaacaaatggaagaacattccatgctcatggataggaagaatcaatatcgtgaaaatggccatactgctcaaggtaatctatagattcaatgccaaccccatcaagctaccaatgactttcttcacagaattggaaaaaacttactttaaacttcatatggaaccaaaaaggagcccatataaccaagacagtcctgggcaagaagaacaaagctggaggcatcacactacctgactttaaactttactgcaaggctgcggtaaccaaaacagcatggtactggtaccaaaacagatatgtagaccagtggaatagaacagagccctcagaaataacaccacacatctaccaccatctgatctttgacaaacctgacaaaaacaagaaatggggaaaagattctgtatttaataaatggtgttgggaaaactggctcgccatatgcagaaaactgaacctggaccccttccttacaccttaaacaaaaaatcaactcaagatggaccaaagacttaaatgtaagacctaggaccataaaaatcctagaagaaaacctgggcaataccattcaggacataggcatgggcaaggactttatgtctaaaacaccaaaatcgatggcaacaaaagccaaaattgacaaatggaatctaattaagctaaagagcttctgcacagcaaaagaaactatcatcagagtgaacaggcaacctagaggatgggagaaactttttgcaatctacccatctgacaaagggctaatatccagaatctacaaaggacttacacaaatttacaagaaaaaaacaaccccatgaaaaagtgagtgaagggtatgaacagacacttcttaaaagaagacatttatgcagccaacaaacatatgaaaaatgctcattttcactggtcattagagaaatgcaaatcaatcaaaaccactatgagataccatctcatgccagtgagaatggcgatcattggaaagccaggaaacaacagatgctggagagaatgtggagaaataggaacgcttttacattgttggtgggagcgtaaactagttcaaccattgtggaagacagtgtggcgattcctcaaggatctagaaccagaaataccatttgacccagcaatcccattactgggtatataccgaaataattttaaatcactctactataaagacaccatgcatacgtatgtttattgcggcactgttcacaatagcaaagactgggaaccaacccaaatgcccatcagtgatggactggataaagaaaatgtggcacatatacaccatggaatactatgcagccataaaaaagaatgagctcatgttctttgcagggacatggatgaagctggaagctatcattctcagcaaactaacacaggaacagaaaaccaaacaccacatgttctcactcataaatgggagttgaacaatgagaacacatggacacagggaggggaacatcacacaccagggcctgtccagggggtcgggggctaagggagggatagcattaggagaaatgcctaatgtagatgacgggttgacgggtccagtaaaccatcatggcacatgtatacctatgtaagaagcttccacgttctgcacatgtaccccagaatttaaagtataataaaaaaaaaaatacaaaaattagctgggcgtggcggtgtgcacctgtaatcccaggtacttgggaggctgaggcaggagaatcgcttgaacccaggaggtggaggttgcagtgagccaagattgcgccattgcactccagcctgggtgacggagcgagactccatgtcaaaccaaacaaacaaacaaaaaacttgggttttagagtctatatcttggcatgtgcttctgtggataccacaggagtagaaaagacatacgaggatatgtgcactggccgttagtgtagcatcttaaattgttcttaaggctcttaaaacttctgtcaggttttaaagcttctgccaggaagtaacatatattacttctgcttctgctcacacttcattggccagaacaagccatatcgccatgcccaacttcaaaggagatggagaagtgtacttcagtcctaggcccagactagggtgaagcgagcaaggcactcaggggcagactactaacttctcatcaccatcctcaataatgggtggctgactcattttattgatttgaatgagtatggttaaatttgagaaggactatttcaaacattaaattcattgaatgaatacactggtcgattcctgggcacatatacgattctcttgatttaaagcacttgtctggaaacctttctcacttactcaaattgtgaaattattcacattgataaaaccttctactctggggatcagaataatagatgttattacagatgacggttttatttgatcttctaaaactgtttgtcatccattggttctaaaattgttcctcagtataatttggagcagttaaaacagcagaaaatacataattggaatgaaagctcatttgttgggatgcttttctcttctaggtgaggtgcaattcctacagaccagaagctgcccgagaacaagtccaaattggtgctcacagtccccctcagtttaggtaaatgggcaaatgggtgacggcagtttttaactgtacatctccccccttcctcccccacccagccatccaagggctctaccagataggtgatctgaaaaaaatcccacattgtggacgtgtgatttccattttgcagccaaaaaatatctggccacacggaaactaaatatcttctttcattagtagtaagctggtttagtcagcactctctcacctgaatttctgctgatggtacctgtacatatctagtctagtgctacatcaagtgccagtgagactatacaagactccagaggtaattcggaatccgaatcatagctttagtattacatcccattatcttctagtttttgaaagagtctcagtaaactgcattattggacttactcaactgcttacttttttgtccaaaaaaatagcctttattgtcttaggaaaggatgagatttgatgtactctgccttaaaacacctagcgctctggtttattttgttttaaagaatatcccctttaatacctcttgttctttcacacagtcaaccagcaaacatgaatgaatggccactttctaaatagctctgaacacaaaggaggatacaaagtattattcagcaattataatttatatctagagttagagagtctacattttggctttcaggtgggatcatattttgaaacggtagcttatacaaaaaaggaaaaggattatgaattgcagtcttatttgtcagaatgtataaaacattaagtacaaataaaattaaaagttaatattactcaccctgtactcggtcgtacaggttgacagaaattttctatagtaccggaaagataagtatgatgagaaacccaaaaaccataataatttatatgtattcattctttgtttagggcattatatctggatatctttatatttaatgtttaaacagatccattagcatattgcaagaaagccatctaaaatttcttctatatgttaaaatcttattcttaagatcttgccttagaaatgcttcagaaattgactataaattacccactagcataaaaatctaatcactatgttggaaatttctcccccactgggctaaactgtcatgaaggctgacggtctcgaacgtactaaaatgtgttcccactgaccaatggtgcagatgaactcacacagtagattaattactcaacagataagttttcagaaacttatttcctttaactagttgcctgtaatgttgaattttacagtgcatgcttactaattatcaactgtattctatctttaacacttgcctagggtgaatcacactatgaaatatgcatccctacccatatattcagctaaaacaacaagaggttatgaggattttttggatacagtccattacatttatgcaaatgcccgtaggtaacaaagtcattagggaagaaatagtcagggactgagaatgctgagtctctagtcaaccctttgaacacggagttgagtaagaaatagaaggggggaagttttttgtgtgtgtgtgtgctggcttgttactgaggtctgcagtaactatagattttgagtgcagcagaaatcacacaatggcaataccacttccaaaaggcagctacaatcaaagtgctgagtaggaatccagtctttgctgtagttggaagcctgtaagaatgtgacatattggagctaactccagtgaagaattatcagtaataactagataccattcattaattgactgattgttgcattaatcaaattctgggcaactgtgagcttcccatacctaacactaattcagagaaaatgttttgcagattgaatgaattctttaaaaatagctggaaatgcaacaacatggatgactcttatagacattatattcagtgaaagaaatcaaagaccaaacagtacataccatggattccattcacatgaagttcaaaatcaggcaaagctatggcaatagaagtcagaatagtaggttatcttgggagatgctgttggtatggaacaggcaggagccttctgggtgctggaatgtcttgatctggcagatagtaatatgggcatatacacacaaaaactggcaagtcctacgtttaatattttgcatactttatgtcagttatactttccataaagtttttaaaaagttagaaaaactaatattggtgatgatacagttttaaaagaattttgaagactgttcgaagagtaataggggcatgtgcttggcattcaggagatgctggatctagtctgttaattttttctggaaatttacttaatcattttgggctttagttgtctccctgtaaacagattaaaagaatgccaaccttctttctagcaatattctgctacagttttatacagaacctgttgatgtgcaagaattatatgacatatgctttgacatatcgtttttcagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgctt

SEQ ID NO: 4424 - DNA, 674804 bp, human
atgaaccatccaatctcctgcctcgagtattgaagcctggctactgtgactgtggggaagggattaatggtctcagcattcagtaagtgaatgttccctcaactctcctatttcctatatgttacgtatacctgccactgtgcccagtgctctttttacagccttacaagttctatctccatgcttttctaccctgctgtcctgctctgtgctttaggagtctgacctctattgacattgtcaatttagggttcagtttgaccagtggaagggaagtggctgtattcctgtatccaagggcacagggtgtctttttcctataaccacagatcttcctgggttctagataatggatctctccattatttttctgccctactactagtagccatctactgctcttgatagccccagatccttcaccaatctcatggctgttagtttccctttgttgaagtaaacaaaacgaaagtatttaaagtgatgtgttaagtgaaagtgtagagatattctgctttaaaatgatgagacaagagcttgaaaaatttgttaacagatatttggggaatgtttgtttacaaagaataatttatttctttatatagaattcatcacaaaaagtaatttttgttaagtgcacttaaaatatactttttctcataagatttacttcatccacaagttttatacagcatatcaactgcttaaggtagggaggaaactgagaaaaaaagaggattagtgagaaggggaaaatgagagggaaaactttcaatctgagtgtgagggcctgcagattttcaatactgccatggcgtaatgtatgctgtctaggagctgtagttcttctatcatttagtttaaaatttctactcttgaatgctcagccaaaataagtaatgttagtggcatggagaatggattgatgaggaagcagttttataactctagggcatggctaaaatctaaaatggcaagcgttggaaaacacaacttcttttacttttaaggtgcttcaatttgtcattactgattaagggctctctggattggctctcctggtcagttaaattattccaagagctatctcattactgggaaatggtcacgtgagatgagaatcccttttattcccatgttgagccatagaaaaaggactttttgaagaaaaaatgtagcttaaatataacttacctcatctgccaaggatgttatcatttcttaatcatcacataagccacattttgcatagtggttaaattcggactaactaaaagcttcagtgtttcaaggctgcttattaaagctgttattctctcaagtaaaaggtgttaagtggaaaattttcataaccactgacataggggaagtgcagtggcagattaccttaaaaaatttcactgatagtgaatttttaaaaatcaccatgtctatgataactttgttactcaatgtgtggtttgcagatcagcagcttgggtatcacctgggaaattgttggaaatgttaaaaggtcagaaatagtctcatttccgatcctttgtacatgacctggatccactgaatcatacccactgaatcagaatctgcatttccgcaagactctcaggggtacatgtcaacatttgtgatgcatgactgaagcgcagtagggtagtcattgaagccctgacctcttacctaacccaggagaatcatgttttccaatggtagcagtgccttaaaaagtatctgcaatagcacagaattttcatttgcatataatccaagggttacttgggctaattttagacttaaatatcaaggaagattaccaagaagggattatatgatatcaagataggtgatgttattatttgaaagtatgtaattaaaattcttataggaacaactttccaaatgagaaattttcctccctctctggtcttccttctcagaaacacatctatattctatatgtaatgctggatttttctctaaataaaacttaagctctctccttctccagaaggcacaggtcattcaagagctgagaggttcaaataaactgctgcttctttcacgtatctctaatgtgaagtgtttggaataattagcctaatttatattgcacttacaaacaactgataacaccttttaaacatgctatagaaaagtaaactggagatttttggaaagaatggtttttctttattttgtttctcctttctttgaaatccctgcatacctaaaatatgctagagcaatgtagctatttaagtggtaatttcccctatagtgtggatctccttctactccctcctttatttttctttctttctttctttctttttttgagacagagtttcattcttgttgcccaggctggagtgcaatggcacgatctcggctcactgcaacctctgactccggggttcaagcgattctcctgcctctgcctcctgagtagctgggattacaggcatgtgccaccatgctcggctaattttttgtatttttaatagagaccgggtttcttcatgttggtcaggctggtcttgaaatcctggcctcaggtgatccacccgcctcggcctcccaaagtgctgggattacaggcatgagccaccgcacccggctctccctcctttattttaataaacatgtattggctatctactgtgtgccatgaatgagaatacaaagactaaatctctaccctacagttgctcaccatctcttgtagaaggtcaaagacaccattataatgccatattataaatgctatcacagagttggcaacatatgatggtaaataggagaagaaggggctaattcagtcttgggaatcaatgactgattcataaaagaggtgactgcttttggcacttgttagcatgtgatttatgatacagatatacacaaatgttggcttgtgctttcagagaaggtggttgaatgaatctttaagtagacccaagctgatattggcaggttcgatcagactgagctctgtccaaaatgtaacttgatggacaggattagaataaaataacctctgctaatacgataaaacaaaagtgaatggtcttttgaatgcatctgaatgattagctttataatattcacccatcaccctgaacagtagtaatatttgctgcagtggagacagggggtattagtaggataatcataatgataacagctgatacgtgccttttacatagtgctttcatactcattaccttatttaattttcacagccaccccgtaaggtaggtgttatttgcatttcctagttgaaaaaatggtcaaagtaggcggcagagcctaaaaaagaaatcaggtctttaaaactctaagattaatattctttctactcgaaccagaaccagaactttcaaaagtctcccttcattccagagattataaagaaccttctcccgtgacctgagggtgcttcattggcgagggttgctgaatgtctaggggtgaaaagtgggccttttctctaaaacagaaactgttatttcccttgccaagccagtccttctctgtttgttccatggtgatcagaacaatatggtgatttaaagttggtgataaaggcagagtggaattgaaaattcctccagggtttttaatttaaccgtgggtagatggtggggccattaaggaagacaaataatacacctagggttggattttgggaactaggctagctttaagggcaggcctggtgttgagaagctagagtgatgagcagaccaagcctcaatgctgtggcttaggggaaactgggccagtttagatagtgtctatcatcaataaaaggttgggcaaaccagagagtaactctcctggagctaaaagtcttgcattatgattgatattgtccatctcagttggaggaagacgtgaccactgcctgtaatataaatgcagttggggggattggtaagggttagggaagatgacagctttgcagctaaaattctagtcaatgttaggggactgaaaggcaaatcataaaacaaaggcagaggcccagtcaagtggcctgagctaacatggcaagggcaggggcagcacttcaattcaatgacatgtaggaatcctatttttaggcaggagctaagaatgcacagtttgtgttcaaaatggagaattccttcaagatatgccaggcttatgataaaaagacttatttttaatgtttttaattttaggtaagagtctttgaaaactgctggcattatttaggactggcttgagcagtagcaattctcagatctacaggtttgagcaaagctgggaaaagtgtaatttattctgagattaatggattatcacacacattaatttataattttatttataattaaataatttattatttatgtcatattgactcactagaattatgatccattggcaaagatcaaattcatcagatttaatataaaattctatgatggcatttgtggtagacagaataatgtcccccaaaagatgcccatgttctactctctggcgcttgtcaatatgttaccttacgtgacgaaacagactttgcaaatgtgactaacgttatctcgagatggggagattatactgtattatccaagtcggcccaatttaaggacccaatcacatgggtcctcaaaattggagaacatttcccggttgtagtcagaaagaaagatggaagcaggagaatgattcaacacccagttgctagttctgagacactgggagtatctgagatactgggagtgtttagagaatgaattctgccaagaaccataatgagtgaggaaagaaatcttccgctagatcctccaaaaaggaatgcagccctgctaatgccttcattttcgcctggtgagactgatgttggacttcttgcctacagaacagtaagataacagaattgtgttgttttaagccaccatgtttgtgggaatttgttatggcagcaatatgaaacccgtataattatgctatatgagttggagatttgtaaattgtaagctcctcacaggcagggatttctgttttgttcagtaacatatatcaagtgattataacagtgcctaggacaagtgattacaacagtgcctaggacatagttgatgcccaataagtgttagttgaattaatttatttattggtcattccatcaacaaatatttattgagtgcctatgcatacgtgcttggtgtgctagatgttgatggggatgtaaagatataaaaaacattttttcatgaaatctgagtcaagaagcttagatcagtcttgagcaagaataggagtcagaaaattatggcttgcaggccaaatcttacccactgcttatttttataaataaagttttgttgaaacacaatcatgctcattagtttacatgttgtctttggccactttcatgctatagtggcagagtagagtacttgtgtagttgagacagagaccaagtgacccacaaagccaatattgtttactctctggtcctttatagaaaacaataacaacaaacctgtcaactcctgagttagaaccccatcttcatgggttgctagctgtgtactttaggaaaagtgtataacctctttaggcttctcttttctataaaattgaggtggtggtacttttctcatagggtggttgtgagaattaaatgttgagtgagaattaaatgatggcttccagtccttagtatagaggaataattcagtaaatggtagttaagatttttttaaagacaattttgagagcagttttaggttcacaacaaaatggaagggaagatacagagatatcccgtaaactttgtaccctataaatgcatagtctccccggttataaacatccactaccagagtggtacactggttacaactgatgaacttcactgagacatcattattactgagagtccatagtttacatgggcgttgtgcattctatgcatttgaacaaatgtatgaatggcatgtatccaccgttatactatcatatagggtattttcactgccctagaattcctctgtactctacctattcatacctccccttcccctaacacctggaaacccactgatctttttactgcctccataattttgccttttctagaatgtgatatagttggaataatatagtctgtagcctttcaatattggcttctttcgcttagtaatatgaacttaagtttcctcagtgtctttccatagcttgatagctcatttctttttagcatatgaataatattccattgtcttaatgtatcacagtttattcattcacatactaaaggatgtcttggcagcttccaagttttggcaattaataaagccgctctaaacgtctgtgtacaaatttctgtatagatataggttttcaattcctttgggtaaataacaaggaggtgattgctggattgtatagtaaagtatgtttagttttggaagaaatcaccaaactgtcttccaaagtggctgtgccatgttacatttctaccagcaaagaatgagaattcctgtgctccacatcattgcgagcatttactattttcactgttctgggttatggccgtcgtaatagatgtatagtggtatcacattgttgttttaatttgcctttccctaatgacacgtgatgtggagcatattttcagtatcatactggaagtcttagctagcaaaaagataagaaaaggaaataagagatacacagtttgaaaagaaagaaataaaactgttcttatttgtagatgacatatttgtcaatgttgaaaatctgaaagaattgacaaaatcctcctggaactaataagctattatagcaaggttgcaggatataaagttaatatccaaaaattaattgctctcctatataccaacaatggacatgtaagatttgaaatttaaaaacacagtgttatttgctgtagcaccccccaaaatgaaatacttaggtataaatctaatgaaacatggacaaaatctgtatgaggaaagctacaaaactgattaaagaaagcatcttttcatatgcatattgacttctcacctctagctatgaaagttctagataacatcttcttctgctataaggctgtttcatctaaattgaaaatctgttgtttaatgtagccactttcatcagtgattttagctagatcctcctgataacttgccgcagcttttataccagaacttgctgctttaccttgtacttttgtattatagagatggcttcttttttcatttcttttttttctcttctcttctcttcttttctttttttgagacagagtctcgctctgtcacccaggctggagtgcagtggtgcgatcttggctcactgcaacctctgcctcctgggttcaagcgctgctactgcctcagcctcctgagtagctgggagcacaggcgcatgccaccacatccggctaatttttgtatttttagtagagacggggtttcgccatgttggccaggctggtctcgaactcctgacctcaggtgatccacccatctcggcctcccaaagtactgggattacaggtgtgagccactgcgcctggcctcttttcttaaacctcatgaaccaacctctgctagcttcacacttttcttctcagcttcctcacttctctcagccttcatagaattgaagagagttgggcccttctcatggactaggcctttgcttaagggaatgttatggctagtttgatcttctatccagaccactcaaactttctccatatcagcaaaaaggctgttttgctttcttatcattcacatgttcattggagtagcacttttaatgtcattcaagaacttttcctttgcgttcacaacttggccaatgtttggcacaagagtcctatcttttggcttctcttggcttttgacatgccttcctcactaagtgtaatcatttctagctttgaatttaaagcgagagacatatgactcttcctttcacttgaacacttaagaggccattgtagggttattagttgtcctaatttcaatatttttgtttcttagggaatagggaggtccaaggaaagagaaagagatgggtgaatggccgttggtgaagcagtcagaacatacacaacatttatctattgtttgccatcttatatgggcatggttcatggcaccccaaaacaattacagtagtaacataaaaggtcgctgatgacagatcatcatagcagatataataataatgacaaatcttgaaatactatgagaattaccaaaacgtgactcaaagacagaaagtgagcacatgctgttgaaaaaatggccctgatggacttacttaatacagggttaccacagaccttcaatttataaaaagatgcaattttttttacaaatggaatgcaatttgtaataaaatggaatgcaataaaatgagctatgcctttatataagcccagacacacataccccacacactatatatatatatatatacacacacatatatatgaatacatacacatacaagtatgtataatgaaatacattattgctagtatgattttgatctgttagatgttagatcaattaagaataaaaaaagtaacagtttttattttactggcattcattcttttttcaatgccctttctttaggtagatatgagtttctgacctgtattgctttccttctctctgaataacttaatatttcttgcaaagcaggtctataggtaacaaattacttcagtttttgtttgtttaagaaaaacttgatttctgcctttttttcgaaggataattttgtagactatagaattttaggttggtgggccttttttctctcaatactaagtatttcattctactgtcttcttgtttgcatggtttctgaagagaagtcagatgtatttcttatctttgtttctctttatgtaaattatttttcctctctggcttctcttaggattttttttttttttttttttttttttttttttttttttgagacggagtctcgctctgtagccctgtagcccaggctggagtgcagtggcaccatctcagctcactgcaggctccacctcccgggttgtcaccattctcctgcctcagcctccccagtagctgggactacaggtacctgccaccacgccccgctaatttttgtatttttagtagagacggggtttcaccgtgttagtcaggatggtctcgatgtgctgaccttgtgatccgcctgcctcggcctcccaaagtgctgggattacaagcgtgagccaccgcacccagccaggaatttttttaaaaaaagtctttgacttcctgtagtttgaaaatgatatgcctaggtgtagttttttttttttttttttttttttttttacatttattctgcttggggttttctgaacttcatgtatgtgtggttaggttctgatattaatttggaaaaattctcagtcattattttttcaaatacttttttctgttcctttctttgtcttctttttctagtattcccaatatatgtatgttacaccttttatagttgtcccacagttcttgaatattgtgttctgattttttaattcagtcttatctttttcttaaattctttttatttttttattttgtttttatgtttagtctttgttatctttgcttttcacttttaaaaatttctattggtatattctcaagcttggcgattctttgcacagctgttttcagtctactaataagcccatcaaaagcattcttcatttctgttacagtgttgctgattttagcatttctttttggttctttcttaggatttgtatttctctatgcttacactgcccatctgtttttgcatgctgtctactttaaccaatagagcctctagcatatttgattttatgattaatgttttaaattccttgtttgataattcctatatccctactatatctggttctgatgtttgctctgtttcttcaaactgtgtttttgttttgttttgttatgttttttgccttttagtatgcctttttttttttattgatagccagatattgagaaataggtaaaaggaactgctgtaaataggactttagtaatgtggtggtaaagtgtgtgttgaggaagcattctataatcctttgattatatctcagtcttttaatgagcctatgcctctggactgtgaacttcacaaatgtttctcagttttgttttctcctcttagcctgggcaggttggctagagtggaccggagttgagtatttcccttctcccaggtcagttaggtactgataaaacccctgcttccctttactgggtccccttggaggttttgttttgtttgttttgttttgagatggagtcttgctctgtcacccaggctggagggcaatggcacggtcttggctcactgcaacctccgcctcctgggttcaggtgattctcctgcctcagcctcccgagtagctgagactacaggcgcgtgccaccacacccggctaatttttgtatttttattagagatgatgtttcaccatgttggccatgccagtctcgaactcctgaccttgtgatcctcctgtctcagcttcccaaagcgctgggattacaggcgtcagccatcatgccctgcccaccttggagcttttaactccaaggtgtccatgccctgcctacggcaatttgtcaatttcagtccagattttcctgcatcagctttggttcccaaagaggtttctgctctgctatgttgtgattctctgtatccacctatctgtctcttcaattttgggggcagcagtttgccttgtgaccacacttctcttatggatctaagaagaattattgatttttcagtttgttcagctttctatcgttaggacaaagtgatgacttccaaattccttacatgcagaattggaaactggaaatccccataaaaatgttatgatttaaaaaaatggattctactgttatcctcctgctgctatcaccactgctaccatcattaagttgaataagaaagacatgaccatgaagggtgttttggaaaattatatatatgtatatgtatcatattttctagaaaattatatataaatatttaatatatatatttatttattaaaactcagatccactttgcttccttggaattattatggtccagcacctactgtttagctgacaacattgcagctggttttatctatatctattatgccattccgatgaagagtagtaaagatctttaccttctcagtctgggctaatttttgatttgtcattatgctttaagaagatttttaaatgttttaatttatataattttgtacaatattttcatcatatttactgctaatccctgaagtccccacgtattggttaatggctagacttctgtgtgtatggtacattgtgtcttcaaagatggcagtaactatgtttcccatcccacatactcttttgcaatgtgatcttgtcactcctttatgaaaaggtggagtctgccttttttccctgttgaatctggcccattcctctgacttgtttggaatggaatgcatctcaagtgatactgcgtaacatcaaaggatgagccttaagagatctgtagcttactcattcacctttttcaatggtcattcttcgaacccatctaccctattgtgaagaaacccaagtagctatgtggagagtcccacctgcaggagaactaaagcctccagttgagctcagtaaccatccggtagccagccatgtgagtagagccattctgaactttttagatatccctgtatcttagccaacaccatgtgaggcagaagaaacacctggttaataaacagaatcatgaaagataataaattgattttagaagccactaaatttttggatgcatgttacacagtaataggtaactggaatactacgtttatgtgacgacttttttttcttcaagatctctaactgttcatgggagtctatgacatagagtttttaaaagtcagatgaggactagcaatacaggtgttaagccatcatttagagtcattttcgaaaatttcaagtttttttctgaagagaagtgaaggctgaagagggttgaggagcaataaggatgtttccaatcagaaatctgttactggagggggcatcatctggaaaatactctgaataaaagtaaaatttccttatcttaatgttaagtcgccacgatttagcagtgtattactttttcatcttggcgtctttactactcaccttttgctttcttttcacaattccatcactcgtgtggtttctcctgtttggaagaactttctacttttgaattacttgatgaatacctacttattttatgaaggccagctcaaataccacctctcccagaaagacattcctgatactcttagccaaaaattctgtatatccctgggtatgagatgttatccaagtttatgcatgcagagaataaaaatattggctgactcgcatgtatttcgaagatattcgaatatatttgaatatatttcgaatgtacttttgaagataattctcaatgatggcttcacatctgtattgctagtactcaatacatttgaccaatgtatattcctactatattagtctactgacaatatcaaatgtatcaatagagttacacatgcatatttaaaatcacatttataaaacctcagtgattttagaaatagtgctttgttctgttttcactttttttgaacaatgttcttcaaacttggcacctgtaccttcagtatcattgtctttatgatcattagaggtcactccttttggtcctccaacatggttttacataagataccatctttgctttcacttatgttgtttgatatataccacttcctataatgttgctactagaagctttaacccaagctgcaaaaatccgtacctgtgtgattagaagagtgttttgtttcttattttccattctttaggcatatattagtgatttccacaaattaaccatgtatcctcatttgcacatgtaaagccacatgccccaggattatttactgagtttaggccaaatgtgttttcctctttaaaaaactgattattattttttgcttggtgacttgtaatatagaaaaaaaaaaccctgattattttagctgaaattggttgatactgatttaaaacaggtgctttcaaccctggccgtagcctagaattacctgaagggcattaaaaactacaagcagggcacactgaggtcctctctcccgtattctaatttaattgatctgggacggagccttggaatgttagtttgtgaaatctccccagatgattctaatgtgcaacaagagtttagaaccactgatctaaaaccaatattagtagagcagtggttttcaaaatgaggtcctcagaccagcagcataagcattacttggctatttgttagaactatgcctgtttcagccccaccctagacctcagaaagttttaggatggtgctcagctatctgtgttttaacaaaccctccagttgattctgatgtacactgaagtaagagacccactggtttaggctaatatatttttctggaatagtagtttgttgttcaaagtatatttactgatagaacatgtattctggaaaaatgtatacggaatgcaatataagggagaggtcatttgtagaaaaatgacttgccttgtattcaagcatatatagtaacctctcctctgaattcctatatataatgctttaactgtacatcttttagatattgaccacatttcacattgcaatgtagttaattgcttaagctttttctctaaagctaggctaagtattctgagaaggatccaggatcaagcaagagtattaagaatagggatcatgaacagatgcgcaaactagaaggtgacagattaagtggcattgatcagaggatacctcaaaacagttattctctcagctttcctctggtctgaagtctagcttttattttatgcttcctctagcctcctattttgccctaatttctagaaacataatggagaaagagatggcagtgttctaattatttcacggttggttccaagcaatgggaagtgggttggccaaataattcctctacaaggcatggctagctctgtgcattttcaaagggcaagcgagtagaggaggcacccattaactctggggccatatggatagatgcatataaaatacaagaattttggccttattggctgtacaacacagtgcctatagttaacaataaggtattgtgtacctaaaatttgttagcagggtaaatttcatagtaagtgttcttacttcccccaagcacaaaaccacaaaggcacacaagaaaacttttggaggtgacgaatatatttataacctggattgtgaaggtaacatgagtttatacatatgtacaaaatcaccaaattgtatatgttaattttgtgcagtttctgtataacaattataactagaaaattattccttaacaattataactggtaaaaatagattttaagagggtgccgttgaccatgatatcttagggctcaaacagaggcaagtgagactcctaaagcataaatcttcttttcagtggtaattttaggagttagccacacaagtggctgataaatatacaatgtccagttgtacagataaatacacaatgttctaatgttacctcaaggcctgaatttaggaattgaaagtctttggtttttcacagtggtgaagaaaccagtagtaactttaaaatacccttgagtttccctctgctcatttatctcccaaatctatagttcatgttttctttctgtgatatccacttccttgtaataattggcttctgagattaataaattcttgaaagcataggaaaaaatgaaaatttgtctctttgagagcagggacaagtttttttaagagagaagaatgaaaagatgcagttattgtttttaaagccagaggcagattgtgctggcaataaaggagaatttgtgagatgctttgtggaattgaaagttctgctttgctttctctgccacacttagagagcctattcatctgtcctttcaacaccaccagtatttttgtaaacatgaaaaacacaaccaaataacctcaagctcttaattgctgtggaaacaagctgtaggaaaaatacaagactgatgacgtataccctgagcattcattgctctgtaacaatattagaagagaacaaacaccttgagatggttctagttttgaacatctttccttggggaatgcattcaggaataatctcttgagtttgcagaagatgtgcattgaatttctttaaaaggatgggaatctagaaagtagttccctgccaggtatcaccaagcagaaaagctcaacaccattcttttctgcttctaggtgctttccagtgccccaaagacagagatgttaaatgctgcattgcccacattcccttggagctggtgttcttcatgtctgccaaggggatatattaacactggatattgggaaggcagaagcaagcaccatatagcatggcccagcagctctttcgaaaggcaaggtggtggatgcatttggttcttctgaggcacatgtggagaagtagtgtccactcctagctttatgggtgtcaagtagagggcacctgtaaaaatagcaactagggatttcgtggaacactcctatacagtgattggaacttctcatggctgtatggctgctggctatgtatcatctaagctcatcccaaacttcttaagacctctggtctgtaaaggtatgtgacctttggctagctaccatttctctccgagtccacattatgaaactatacctttcctgttcatatctatatacattcatgtttctattaaattgatcagttaaaataaataggtatcttaatttatttgagttgccctacttggccatcgaaacaaaactaacagtaccatctcacacatggacacacacacacacacatacacaactaccagctatgtcacgttccttggttctctcttgaggctagcaaaaatcgtgtttggaacctccatctcacaagcaattacaagtagggttcaccccagttccttcatcatctcatcactgggtttcagaaggggccagtgtcacctaaggaattcatgtttagcatgcaggctgttaaaaagggacctatgaagacatggtaagactagtggagaaccaagggacttgatggagtcagggtgtgtgtgtatctttatgtatgtgcacacatgtgtgtaggaggcaactgagtttgttttattttgatggaaaattggcatctcaaataaattaagattccaacttgttttaactgattcattgtgtatgaattgtgcaaaaatgtgagtggggaaggtgtagttttataatgtcaaaataggagaataaacttttctttaaataaagatcactatttattccaaaaatgttgacaaaaaagaaaagaaaggttttatttcattaccaatggttttaaaacagagttgaaatataagtgagaagagatggggatgtacaacatgttgctggaggggcagccacatacaaaaactgttgtggctgcaaagggaaaactcccatcagtatggatttttacagggtattctcaaaagaaagctagattacagaagaaacaatcgttagaattacccaattattacgttagatttatcttttattttgaggaaaatgggactgaaaacagagagagtagaataaaaataatcaagagggaagtaaatgctgagatacgtaaggaataaggcatgcctacctgttttaaaagattccatcttcagaactatatgaattacctacaagggtaaggaaaaggtgtttgcatatggtaaacatgtataaaacattcttgagaatttggggaaaatgtgtctaacagtctctagtcacagaatgcatatgctactaatgactataacatgaaatcttgtttgttgaaattacaaaataggttgttaacaaattgtgattgaatgcttagaaaagaaaatggtgattactaggagatagcttaggttcaccgaggataccttatgcaaaactaatcttgtttcactttttattttgagttttagatggaaagataaaattccataggcataatgtgttttgatttaaccaatgtcacaggactattttatggaatctatagagggataaatggagaaatgtagactggataatattcagttaaatagattggtagtttgtcaaacaatctcagcttctccccctaacccatgaatagtctttccttcaaaacaaataaaatgtagaatatctcagccattggtcttgtcctactcaacattttaatgatatgtataatgacatagaaggcttacttatcaaatttgcagatgacataaagcttggagcaatgactaatacatcgagtagctgaatcttaattcaaaacaatcttgacaggctggaatgctggccaaagctaacaagatgaaatttaatagttataaatgttaaatcctgtatttaggttcagaaaaaaaaatcaaatgtacaaatgctagatgagaggaaattttgcctagaagccatttctatgaaaagacgtcagtttttttctgactatacgttcaatatgaactgccaacttctattgatagaaggccattcattgagataatatttattacattcctactgtgtgccaacacattaattatcttatttaactcttaaaaaatctctctccaagatagttctatttatctctactttatagataagaaaaccaattaagttgttcacctgtatgctgttattaaatggtaaggcttcaattcaaactagattatctgttttcctggttcagcattccagtagagctttgctactcaaaataatgcctgtagaccagcatcttactagaaatagttgaatcttgggcttctctccaaaccaactgaatcagaattttcattttaagaaaggtttgatctcattgccagtcattttacagaagggttgaaatatatctgagaaggaagggacagggatcttaaggggaagtgtctaaatagtaaaatttgagaagcactgcattgtatcacacctgcctcagattactactatagcgacagggtagtcccacatctgcctcagtttaccactgtagaaacaaggtagtatttcaggagggtggctggttgactagtggcttgagcaggcctcacaggatgaagttattttgattatgtctgtcagtaaccatatctgcactggttatatcacatcggaaaactctgacttggttctttatgccagattttaagatgaaatattaataaactgagaggtccaagacacataaagaagtgttcagatatgttgaaaacaggtctaagaagaactgaagagattatgaatgtatatctctgagaagagttgcaaataaggcaggataattttcttcaagtatttggagggataccacttagaaaggggctgtttgattgattggattcatcttttccatttattttttctcatttatcagatatttgtggagaatctaatgtgtatctgtcattgaaatatacatatcttcaaagtatacgtatctgtcaaagtattaccttttatttgttttggggggaaagactgcatggtgttggagaaggagataaacattaagattattgttgagaataagaaagacaaggtgactgttctcaaggagataataacccaggggttatatggcacacagcacattatgtgtacaggtaatatacatgtaaataaacacatgccaatattatttcagaaaatggtaagtgccctccaggtgatagagacttggagggaactagtttagttcttggggtcaggcggtcaagaaaggcttctctgagatgacatttgagctaaatcctgagtgacaagatggaatcagctatgtaaaggacagagggagagcaatccagataggaagaagagtaaatgcaaaggctctggggaagaattaagcctggcatggtctaggagagtcctaaatggggcaataaaaggatgaaatggccaaatgtagccctccctcccaggttatctgcagattgaatgtgtgtgatgatgggtatatttttcctctgtgctattctcagctatggcggctggctgaaacagtaactgatcggttaccatggtttccaatggaggcaatgtagcatgtaattattatatacagctatcattactaaattcagtacggcatttgatgtaattcaataaataatatgagtcataactctagaaggagggtgtgactgcttacagggtaacatttttaggaaaattacttaaaatatttttttcatacagcttgcttatcggggcactgatgaataaaatttgatagttggttctaattgcttttctcatatcagaagaaaaattggtaaaaggaggtttcaggtctgccttgataggtaaagtagtgttgattcaggtactaaatgaagcaaaacccttcatttggtttttagcatggtatttagtgaatctcatttcgttgggtttgtacatctttaacaatgaaataaaaacacacgctttgtgaaacatataatagagaagagagagagacttttagacaatctaccatctcctccttctctacagattccagagcaagtttccccagtttgtcactgagcactaactaattaaggagttgtcactttcctggcctttcctcaatgttatgcacactgcaggatataaatgtgggtatgagggtaatccttcattatatattcaagggaactgccaagtgtttccatttgtattgttatcatttgaagataaataatttccatttattttaataaaaggcaaccagacatgtatctgtgttaggcttcttcatgccattgataaacccctctcttaatcaattttcccagtcacttgctttcggcattactgtgtgagaaagtgaacgtcttaactaagtcacaaattggcaccaccatatggaaacagagaaagactggtgccaaattgttcttaatatttttataaactatgtatccatttgctaaattttgagttcctcaggaataatcctctggaatacttgtaggaatctactcattgatacccctatatgatagcctcttttccttgtttttctcaaacatatgtatgatattatatgctttttgtcattcgagatgacgtgggataggaatagaaaagtacgaggaagggatattatacacaattccttttctcaagaggtgtatggtctacttgagggaaatgagaagcatgcacagtataggcatcagtagaaagaacacacagacattgtagtatatctgaactgggtttatcaccttctcccattttgcttgtggtgccaattcacctccctgaatttctgctctcttttatatcaaatggacatactcaaaactggataatagtgtacatgcaaagattcaatgataaaaaatatgaagttgataaatactgtacttggcacatagtgaatgatcagtagaaatacaacaaaaaataaggatgaaagtcaaatattttacagagacattgagcactgtgcagttgggtaggaaacacgattggaatatttggggaagccttcatggatgaattaggatttagacttagaattgaagggtaggcatgctttagacatgtggaagcaaggggactgtttcaggtgaagggaatggcatatgcaaatgtgtggatagctttaccattgcattttctattaatttaactttcttcaacactcaattatgttagtatggaactgtgttttattttttaaactatgttttcattcctctggggtcatattaagttgatgttttgttcattatttgaagaattagtgaagacagtctgtattttccatcaagagctgaatgaaaatatcctatggcacttctccaaagattgctaagaaaacaatacatgaagaggcaaatggaggcaaaatttggaaagtggaagttttccacaactgtctttctttggctcattctgctcctctgtacccacttccccactccatccagttattcttttatccagtagcttctttttgtgccttgactgtgttctcccatcctggtgaaacaattggatacgtgaaggccactgagcctaaatgatgtccggctataaatttagtaccacttagggaatattggtattttcagagtcaagccagaaagaaaaagcaaacccttcatggtaagtccctgttttaggtgataacactttactccttaaagtatagtgcattggtgaaagtcggccccagctttgagtaaggcaggtaagctagacatctatacttaaagtgaggggcagtggttgggctgaataagaatggatgccaaatgcatccatgtaggctatcaaaaagatgattataggattacatggactcttcccttgggaatggatcttcatagatttcatatgttgcagctatgaaatctgcgatagataagtagcagctatgccttcagagtcgtggaagtatgtgtttccctttcagcctctccattgattgtactgagagatgctctgatcaggattatgttgcaaaagtgaatggtattgaggccgatcaatattcagaatatctagtttggtgatctgcagtagacactaatgtactgaccagatctcccttcattaaaggatgtgttgtctgcgctgctaggagggatgctggcaaacagtcttcaattttcagccccttcaaagattgccacagttgtggagggcagtcttgtccaaggtcactctctttcctgaggtggctcacatccgttgactgattgatgtaggagaatagaggcatggccatcttcgcccatctcagtaccattttgtggggccattctagctccagagctccacttgggtttggctgaggctgtcagtgggcctgcatcgtagctcaacatcccgctctgcttactgatgtttccttctccccctcctataagtgttgctcccaaagacactcctcaataaatgtgctgcagtctagctttcatctcagagggtgtttcctagggaaccaaacttgcaacagggtgttttcctttaggttaagtcagtcttccaaccaatgtaatgtgggacactggtgtgcaataaatgagattaagttgtgttgagatgttcattctttcagcattcccaatggctgggcctagcctagagtgatgtaagcccagctggtcatctggagtcactagatgccttgactactcatcccaggtgctgtgcaaatagttatgccatgctatttaaaggttgggtgaaggcactgtgtttttaggaatgctccaaagacaaacacactgttattcctaggagatgtcagttttttttgtttgtttgtttgtttggttagacaccatacctttaaggttgacacatttatcagttaacagttgcaaacttgaaagggagagcctagaattctgaggcactgaagataggatagttaagttttgattaggatataaaagaagatgggagtctatattgaacttggaaaaatgtccagttgagaggattatacaaattatttacaaataaatcaaaatatctaaatgttctcttttagactattctctgctattactttcttttttctctaccacgcactcagatttcttcatctccaagagctgcacatagcatttttcctaatacattatattaatttcacagcagcactttaaatagtggcacagctgcagttgtcattgaacagagtatgaaataaccttggagtattaactgttatttattcgtatggtggctcgtgtttaattgtgtgtaggctttgccttaacttataaaaggtatttgtataatcctcgttaataactgtaattccagaagttaaaagttataagagtttacattttgataattaatgctgttcatactagtacctgaagtactttgtaaaaaataaattctaaagggcaaaactgctattatttgggcttaaaatatttgcaggctttggatagaagaaattattccaaactcacgtggggacagaaaagtgtttctctttctttactttagcttccaacaacgttgcttccttcgaaacaggaaagaattgaatggctgtgtgggccagatagggctaatcttgtgtatgtttaaactattcttgaagttcttgcaatattatattttaagcacacagtagtgtgctggaactggttcccatcaccttgtgagaactgactgtagcacatatatttccatctccatatccagtgacattatattggtaacttgaaattagctacggtgagagtatttataccactgcagaagttaacaatcaattagggttttcctctctttaaatccaagggggctggtttttaaacatttgccaatataccactgccgtcgactcatatcattcccagcataaattacagttgtatatgaaatttaaaaatatctaatgtaaaaagcttagaaggatgggccttcacatcctttccaaagttcagatgtatccagatcctggaattttggtggaggctgaatgaattcacaagttttggataacttaggaaatcatgcatcttgattctgtacctcagatctaacattttccaacattaatggctctttgtaggtgttttctgtggccaggtttaaactcactctaataaataaaacaaaagattttcctcagggggttgaagttacttttctttgtttttggatttgaaggtattgtacctgaaatatataggagtgatttgattgattgctcatgtatgattaagctcacttgaattttagtgcaaatagtttacttagctttaagagtatgggtttagagtggagctagaaagtgatggttatctagtagttggggtgggggctggagaagatcatgatctcccccattcagataggtggccagaagcccggaaatccgacttctggcgtatgaagccactgtcttttcctcctcaggatgtgtgaagtccagcattgtaataaaagatacatctgaacacattcagctttgcaggtggtatagctgcagttttaacacaaaacacgaaactttccatgtatttttactttcaactattgcacctgggaggtccatagtcagggtatgccctccgcattgctcctcactgagcccccaatagttacctcgttagatatgattacctccatatagacagtcccaaagtattataacagtgtatttgattgtaatataaatattttattacacaaaacaaatgggagcttagagtaatagaaataaaataaaataatgatacacattgaagactgtgaaataatagttaaagggggcaaaatcacaggaaatgcctttctcggagcctaattaactaaatagaaaactggtttattttttgcaactaaaaaaataaataagtagaaagcagaaaaggaaaatgagacaagcttatgctgtaaaattgaaaagtgacagaaaaaaccccaaaactctgcatagtctagtgtagcagaaaataactcagcaaagatagaaattgaataaaatcccaagaagtcccctaaataccactcaatttttgggaaaacataccaaggagataaataagcaatactgggaaaaatcaagaaacatatctttctgactaattgctcttttacattcaatggcaaaagaagcacaatgcttattcttttctgagaaatagggctgagttcagagagcaagctgggtggactgggagttggtacaggatttcagaagagaaagcagagctcaaatttcccgatgactgtttaaaagagttctaatgaaatgttaactactcggaatccatttccataaacccaggaaggattgaaaacactcaaattgaagctcagacaagcaggaaaaacaacaacaacaaaacaaacaaacaaaaaaaccaaaaccctgaaataaagtatgaatggtgtcaaggggaattcactcagaaatgtatctggacaaaaagaaagtataaaatatattaaatatgagacagatgaaaagaagtaaaatagaagctctaatagaatggaacaaaaatagaaaacgaaaatcagtaatagaaagagggaaaaaatgagtgaaaagagccaggaagagcaaaaccagaagaatctaatcttgaataaaatgcaaactaggatacagaagaaagtattccaaaattgttcatgctacagaagaattcacaaagaatattcatcaagttaaaatagaactacaaagataagaagatacaaaagagtaagatgtaaaaggagattgaacaataagtaagcaaattgagaactaagcacaagttattagcttatacataaatgagaaagacacagctgaaaataaaacttccatacaaaatctggagcgagaaaagatttagagatatagtagaggaaaattttttagaaacaaagaaaaataatcccttgaaacttaaggaaacacacttcatagcaggaaaaattatttgcaattaatgacactgagacatattttgattcactcattgtgcttaagaataaagaaataatttttaagtaatcacaggtcttcagatatccaggggaaaaattagttgattcagagggagaaaaaaaaaatcagggtagtcactattattcaagaagtagttaatttcttcatccaaataaaaagattggtatagttacttttaatttcaagattaaaaaaatggtctagggaaagtaaatggcatacttggagttacagatcaatagcagagtttatactagaacccagatgttctgatttgtggtcaagcatttggaatatcaaatatgtagcttctttcatccatatgcaatgtgccataaaacttttcttttttctgtatcttaatttgcttttgattaccttggccctcctcattcaggaaagccattataggcattaaaatgagatatacagtgaaatatcatgattttctggaaagatagtactttctagacactatgagtttataactgttactaggtaagagtagttcagagtagaggccagagaaaggcaagtgcagttcagtgtcaggggcatggacagtagaatttgacctagaagaaagcccatgatcaaccttctaagggactcaggagaagaaaactacggaaacgacagtttttaaattcaatggagaaaagatatcatacggaaaaggcagcatttattttttattaatctctctaggctctgttcagataatgatccaattatatcagtcaccttggatagagaacataaaagcataacactacagagcagcctgaaattatagttactggtagccgtgtcttgcccccctagaccccatttatgcactgacattagatcatctttgttatttgtaagttgttgtaatactttttgttgtgagatttttacgtttgaaatgaagaaaaaaaataaagcactaacctttactaacctaccatgagctgtgttttaggaattgccttttggagtaaagtgtacattctctattcatgctctgttttttttctgtctctgtgactgagggagaaaaaaacttcataaaggaaagacagtgtcctttaggaattactatcatgaccttctgtgtgaaatatatataggctttgtaacagcctatggatctattaaatttctttgctgatagcagcagtatttaaaaaatacttcaattgcactattcctttcttgctacagctcaagactgaagaagctgaagtcatcgtgcataatggctgtcacacacaggtcacatgataaggagctcaaatctagctactaactaattggaatgtctgtttacccaaaagacaggcagattcctgccaaagtgtatctctaagtttgtgatggtgtgagcatgttcctgtatacaaggaaagaaaagcatttgccactaagaggacagattaagttttaggtattcgaatagcttttgtaaggtctactagtattatttttccctgcttagctgaaatgttgttggttattatacttttgaatataaattatattgtagttaaaagtgtcacttttttttttccataggagctggaacagatgaaattacactttactataattgaatatttctgtaagaaatgtaaaaatatttttttgtgtaactgcaagtacacatgtgaattaaatatgagtcttaataaggtattacatctatctagttaagtaaaagtaaaaattatgaattactacttaaaatgaatcaatagctttagagtttgaaaaactaataacccaacattaatcatttattcattaatcaatcaatcaattattcaccaaaaattgtattaagcacctactatgtgccaggctagaattgtactagtaaaaaagacaatccatgatctcacaggctttccagtctaatgcgttaaaaagtaagtcctaaacaaagagccaaagagtataaaatgtctagggatctctggtactggataagagtaaacaacttcactctgtgtctcccagtgaatatggctgtaaaagttggaatgaattcatggagcaggtatttgaggggtctgaaatataaacagtagcaggcgaaagcggaaagaagacaagaattaaaagtagcactgagctggcagtgagtttatcccgtttttccttcagtatctgccagcatgaagacaaggcaacctggaacctggaagcaggcttggggtaaagagagagagctccagaagaagacctctatttctggctctagaagcaggaaaatggtcttctaatgctcagagttggggaatcgcctactttttttttcttttctcttttctctcacacctcagcccaagcaatccaatgacagcagggtgggtagatgtaatagagaaaaaaaccgacagtagcctaaaacactgagagaggagaacttttctctgtgatgggagaagctgagatcccaagaaggtgtggcaaactcctattgaaatttttctttctctgtcttctggtcacttgtccctaaacacagcacaggtggcaggaaatgtgcaccaaggtaaggtaaataaaacttcagatttctggctagaggaccacaaacaagagccccagggaaccagaatgtcctggggagatggtggagagggaatagtttgggaaaataaacctcttaaagttcttgatgagctctcaaactcaccgatgactgtgcatgctcacataggacctatacagccgaatagaccactgcctaggtcacagactggccacttggcggtgcagatgagggacagttccaatcagcactgaaaaggctttgaaattggaacccacattgaaagcacaacctacagaaggctggcaagaacttgtggcctcaacctaactgggtcaattacctgctaaaacaataatatcaacattctccatatgatttaaacaagatccagaagcccataatatgatattcaaaatgtccaagatataatgcaaaattactcagtatactaggatcattttacgtgcatgagaaaacataatcaacacataccagcactgatattatataattgttggaatgttctgacagagacgttaaagcagctattgtgaaaatgcttcaagtaagtaaggatgaacgctgttgaaaaaatggaaagaaaacctcagcaaagaaatcgaaaatatacagaagaaccaagtgtatacttttagaattgaaatataaaataaccaaagttaaagaaaagaaaaactcaccagaataatttaacagcagaatgaaggcgagagagaaaaggaatcagtgaatttgaaaataggtcagaagatacatcagtaaaaatgatccactttgaacatttgagtaaaaaagacttttaaagaatgaaaagagcctcagggacctgtgggagaataacaaaaagtctaacatttgggtcattggaattcaagaaaggagaaagagtaatatgcagaaaaaatatttgaggaagcaatgaacggaaacttcccagatttggtgaaagacaaacctactatagattcaatactgtagatttaagaagtttagtacatcccaaataagataaatgcaaagaaatccatacccagacacgtcataatgaaactgctggaaaataaagtcaaataaagaatcttgaaaaaaatcagggaaaaatggcacattacttttttttttttttttgagatggagtctcgttctgacgctcaggctggagtgcagtggcgcaatctcagctcactgcagcctccatctcccaggctcaagagatcctcctgcctcagcctccttagtagctgggatgacaggcatgtgccaccatgcctggctaagttttggatttttagtggagaccaggttttgccatgttggccagtctggtcttcaactcgtgacttcaggtaatttgcccacctaggcctcccacagtgctgggattacaggtgtgagccagtgcacctggccaggcacatagctttttagagaataatgattcaaccaagagctgatttctcattagaaaccatggatggcaaaaggaattggaacaacattttcaaagttgtgaaagaagagaattatcaacccagaattttacatcaagcaaaaataatccttcagaaataatggcaatctcagatgaagtataaagagaattttttgccagcagaactacctctggaagaattgctaagggaagatgttcagaaagaaggaaaataataccagaaagaaacttgcaacattaggagcgaaaagaaagagaaattgcaaatatccaagtcagtatcattggctctcattattttattgcattacttaaatatttttgataaatgaaagcaaaaactataatgcttgatgggtttttaatatttgtcagtgttatacataagagagttacaacataaaggaaacagagtaaagggacttatatggtgaaaagctttctacagaccacttgtagtggtagaacgttgattctatgtagataataataagtttagtataaatgttataattcctatagcaaccactcaaaaattatataagaatatacgggctgggcgcagtggctcacgcttgtaatcccagcactttgggaagacgaggcaggtgggtcacctgaggtcaggagttcaagaccagcctgaccaacatggtgaaaccctgtctctactaaaaatacaagaaattagccggttgtggtggcagatgcctgtaatcccagctactcgggaggctgaggcaggagaatcgcttgaacctgggaggcggaggttgtagtgagctgagatcgcaccactgctctccagcctgggcaacaaggtgagactccggctcaaaaaaaaaaaaaaaaaaaaaaaaaaaaaaaaaaaaaaagaatacacagtaaaaagtagagaaattaaaatggaacactaaaaagttaaaacaacctaaaagaagacagaaaagaaggagcagaggaataaaaaaaagaaggaaaaattgaaaacaaaccacaattacagttggagacttcaataatcttctctcaataattgatagaactcagacagaaaatcaacaaagttataggagaatgtgaaacatcataaattaatagtgtataattgacatttatagagcactcctctaatcaacaggagaatgcacgttcttcccaaatgtacatggatcatttatcaagatagaatatatcataggacataaaacaaaacttaacaaaattttaggcctgaaatcataaaaggtatgtcaatttattctctaacaataaaagaattaagttagacataaataacagaaaggtaagagtaaaaatctccagtcatgtggaatttaaagagcatactcctaaatacttcatgagtcaaagaggaagtctcaacagaagttagaaaatattttgaactcaacaaagatgaaaatacaaccgatctaatttgtgacatttaggtaaagtagtacttacagggaaatttgcagcattaaatgcttatattagagaagagggaagttccaaaaatcagtaacctaagcttccgtcttatgaaactagaaaagaaagagcaaaataaacccaaaacaactagatggaaagaagaacaaagataagaggaagaatcaataaaattgaaagcaaaaaataaagaaaattaatgaaatacttgttattgtgaaaagatgactaaaattgattgaaactacagtaagacttaataagaaataaagacacatatcaccaatatccaggaatgaaagaagagatttcactgcacactctacatacattaaaggggtaataagggaatactatgaacaattacacaaacataatttacatgaaatggagaatttctcaaaacttacaagttgcatattaatgtttgctgaagatgaaataaataacctgatagtcccataatcattaaagagattgaagtcatagttaaatttttccaaaaagaaaatctataggccaagatggtttcactggtaaactttaccaaacatttaaggaagaagtagcaccaattgtacatagtgcctctcagaaaattgcagagaagagaatacttccttctaaaatagatttaatgaggctagcattaccttaatattaaaaccatacaaagtcagtacaaatgaaaaaataaaagtatatattaatacccccatgaccagagatccaaaaatcctcaaaaaaatattaacaaataaaatccaacaatgtataaagggaataatacaccacaaccaaaagggctgtgtctcaggaatgcaagacttaacatttgaaaattaatcagtgaattccatcatattaacaatctaaaaatctaaaaagcacagttatatcaattgacatagaaaaagcatttgacaaaattcaacatccattcatgagaacaacactcagcaaactagaaatagaagggagtgtactcaatgtgatataggatcaggaataagacaaatatgtccactctcactactcctattcaatattgtactggaaatactgggtagtgtataaggaaataaaaagaaataaaaggtatataaatctaaagagaagaaatacaactgtctctattccaaaatgacgtcactgtttatggagaatagtccggggaatctataaagacttcctagaactaatatatgagcttgatgtggtcataggctactaggtcaaaacacaaaaaagtcaatcatatttttatatcctgcttagcaataaataattggaaaccgaaatttgtgaaaaatatcatttttaatagctccaaaaaatgaaatatgtatgtataaatctaacaaatcatttaaaagatatgtatgttgaaaacaaaatgctgatcaatgaaatcaaagaagatctaaataaatgaagagactctgtgttcatggatttgagggctcaacatagtaaagatgtcaattttccccaagttgatctatatatttaacacaatttcaatcaaaatcttagcaggaatttttgtagatatgttagttttttactgctgtatatccaattaccccaaaatgttgtgactgaaaacaatatgcatttattatctcacaatttctgtaagtcaggaatctggacatggattcctattatacatttctgacaggctgcaatcaagatgtaggctgggctaatcttaactcttgactggaaaaggatccactcccaagctcatgtacttattaacaagattcagttatatgtgggctatttgactaagggcctcaattcctatatggttgttgcctagaggcctttctcatttctctaacatgtgggactccccaacatgccaattcgtgtcatcaaagctagcaagagagagagtctgttgtcaagacagcagacagattctttttaaacttaataatagaagtgacattccctcaacattgctgaattctgttttgaggagcaagttacctggggagaaattacacaaggctgtgaacaccaggaggcggggacactggggggcttcttagaagctgccaatcagagtagatatagacaaacggattttaaaatttttatggaaaggcaaagttactataatatctaaaataaatctgaaggaaagtaaaaaggtgaagcaaatatactacccattttttagacatatgaaaaaacgacggtaatcggggcaatgtcatttagcctcaaaaacagatgaatagatcaatgcaatagaatagagagtccagaaatggacccatacaaatatggccaattgatttttgacagaggtgcaaaaatagttcaatggagaaaacatcctttttaacaaatggtattgaaactattggacatccatatgcaaaaaaataaaccttgaaataaacctcacatctaataaaattaacttaaaatggagcatagactgccaggccttgtggctcgtgcctctaatcccagcactttgggaggccaaggtgggcaaatcacctgaggtcgggagttcgagaccagcctgaccaacatggggaaaccctgtctctattaaatacaaaattagccggacgtggtggcgcatgcctgtaatcctagctacttggctagggcaggagaatcacttgaacccgggaggtggaggttgcaatgagccgagatcacaccattgcactccagcctggaggggaacaagagcgaaactcaaactccttctaaaaaaaaaaaaaaaaaaaaaaaaaacgaaaaccatagacttaaatgtaaaatggaaaattacaaaacttttagaagaaagtataggagaaacattttcataatgtgggattaggcaaagagttcatagaccaaacaccaaaagtatgaacaattgaagaaaaaaattaacagagtggacttcatcaaaattaaagactgttcctctgtgaaagacattgttaagagaatgaaaaggcaagctaaagtctggaaaaatatttacaaatcacatacctaacaaattatttctattcagaataattaaataattataataactcaacattaagaaaacaattttaaaatttgcaaaactcttagaaggcaagcccagtgaggttgccagatataagatcaacaagcaaaaattaattacatttctgtatgctagaaataaacctatggaagaaaaaatttaaaatgcatataatttatgatagcccccaaaatatgaaatacttagtaggtattaatctaaccaaacgtgcagactgagcgctgaaaattataagatttacctgtgtaacaaacctgcacttcctgcacatgtatcctgaacttaaaataaaattaaaaaaaaaattcatgaatgaaatcaaagaagatctaaataaatgaacaaccatagagtgttcatggattcagaagacccaagataataaatatatcaattctttccaaatctagattgaacacaattactagcaaactcccagaaaaagtttttttgtagatagataatcttattttaaaattaatatcgaaaggcgaaggagccagactagctaaattagttttgaaaaagaagaaattaaatcttattatatagctacagtaagcaagacagtatggtattagtggaaggatgtacacatagatcagtggaattgaatatagaatctataaatagatccacagttgtacagccaactgtacttttgtacaaaagtgcaaaaatccttttcaatggaggagagacagtctttttaacaaatggtgctgaagcaattggatagctataggttaagaaaatataagccttgatgtaaacttcacaacttatacaaaaataaatttaaaatgtttcaggggtttaaatgcgaaactataaaactcttaaaagaaaacataggagaacatcttcaggacttagggctaagtgaagagatttgagagacaacaactgtataattcataaaagaaaaagttgataaattggacttaatcaaatttaaaaacatttgtattgttagggatcctgttaagaggacgagaagacaagccacagactgggaggttgcatttgaaagtcatatgcacaataaagaactggcagctaaaacatattaagaatactcaaaattcaactctaaaaaatagttcaattggaatatatgcaaaatacatgaacaggtatttcagaagaaaaggggatacagatggccaaaaaagtatgtgaaaagatattcaacatcattcaccattagagaaatgcaaattaaaactaccacaatatatacatctattaaaatggctaaaataaaaaaagtgataaaaccaaatgatagcaagggtacagagaaatgggacctctcttacattgcaatgggaaatcgaaaatagttcaggcactctggaaaacatttttgcagtttcttgtaaaacaaaacacacatttaccacacaaatcagcagttgctctcctcggcatttctcccagagagatgacaacttatgttcacacaaaaaccagtacatgaatgttcatagcagcttcatttgtaatatccccgaactgtaaacaacccaaatgtttttcaatgggtgattggtgaaacaaactctggcacatccataccatggaatactactcagcaataaaaagaaacaaagtattgatacatgtaacaacttcgatgaatctctaaggcaatatttttagaaaaaaaaaagacagtctcaaaggttgcataatgtatgtttccatttatattacattctgaaaatgacaaaatattaagttgaagaacagattagtggttaccagaggacaagaacagagggtgggggattggtgagattagaaagcagtagcatgagggagtttcatctgggagatggaccagtctgtatcttgatttgtcaacagtgacacgaacctatacatgggatcaaactgcctaaaactacgcatacacacaaatgattgctcataaaaactggtgaaaactgaataaggtcgatagtttagctaacagtattctactagtgttaatttcctggttttgatattgtactatagttatttaagatgtcaccaataaggcaagctggtcaaagtatttatagaactctatgtcccatttttgcaactttttctacgtttttaaatatttcataaaaggctaaaaaatattgagctaaagaaaccacacacaaattaatgggcaaagtcttgaatagatacttcatcaatgaggatatatggataacaaaagttcgcatgagaaggtggtcaaaatcatccattgagaaatgcaggttcaaaccatggtgagataccactacacacccattagaatggccataataaaaaatggtgaccatactgagtgctggccaggatccaaagatgagtagtcctactcattgctggtggaatgaaaaaaaaaaaaaaaattggtaccaccgccaccacttgggaaaacatacacttacatatgacttagcaatctcccttttaggtacttactctagataaatgaacatttatgttcacaataaaagctgtttaggattattcttagcggctgtttgtgatagcaaaaactagaaacaatccaggtctttttcacgagatgagtggctacaaaatccttagaacattcatacaatggaatactactcagttttaggtattatctactaaaattatgtatacctaaattaggtattacctaaaattacctactgattttaggtagtgattatgtgctaaggaagagagataaatcagggaaatgtaatggaagctgttgagagggtggccagggaaggcttcactgagaggttggttttagagcagatgtctgagggaggagagggaatgacccagttatcttcctgcaggaagatattttcaggcagcgggaacagcaattgcaaagctctgaagcagaaatatgtcaagaggttgaagacagaaaaggtcagtaagacaggagtcagagtaagcaatggaaagggagggaggagatgagtagaaagaggtaacaacaggtagccgggcagatttgctggatgaatgtgtcaatgaatcaatagaaaaaattttgtcattcttctacagtacatgttaaggttttatcatctttattttggagggaaaatcccttttatgtccaccttgattcattagtatgcagttgaatactgctactttagcttgatccacatttcaaatggagtcgttattccttacttgattatcatcatattcagcaattgaagttgattattaaattattcctaagttttcaaattgtttctctgcaaagatattattttgcaaccctattttcactttgtcattcttgtttctgaattctttgatgattctttcccagtccctcttctgtgatgcaatcctggaaggacttgaaattttattaggaatctgacctaagttgtacacagagaccagtatatactctactccaagtttaaggaacacaaaattaaagcccatagcccaaacttttctgagaatatgaatgcttatgagttttagagacagttacttttttatgaatactcagctcttgatactgctgcttggtgtggaaactgagcaccgtttctctaatttgaacttttgagggacactttgctctccttgcagcctaaatgctgaatatttatgaatttttaatacatggaactcctaaacatagctgaagaaaaatcaaaatgataagggatcatccaaattgcaaatctttttcagatgtttcagaaaagatctcgtttcagtatatgaataatgatgtgtaatatagaaaccatttatttcactaagagttaaaacaacatatatcaagaggataaaatgccactttcccaacttctgtagctggggcaaagtcttgaatgaactgctgggcatttcttttagtgtcaaggaagaagggggaccattttcacggcagcaataggtatgaaaccaaaaaattaagtaccaccacactgaaggagaagaagggaactccttacagattcatttagtgcgtttatcgccctgtcttcagggtggtccatgctgaggatatgccaggcagataaaagtctaccttatttttaaaagcagatttctttttccaggaagaaattctctgtgggaggagcattgcccatggatcagtaaataagcacaacaggaatggctgctttacagggaatgttttctctttggggattctgtgaggtaaactcagtagactggtttttattaagtgccaaaagaaaaggtaaggttgtacatataaattcttgctgctatcttttatgtagaagtatatacacacgcacgtatgtgtgcatgtgtctgtgtatacacaaatactatgtagaacccacaggcctcaccttacctctaggagtaggaggacatattctgggatgtggttttggggatctcaggaagaatttcttaacctagaaacaccttcacaactccagagttgatgtttgaaatttcaacactagcactttgtttctttaaagtctttttttttttcacttgaatgctgcctcctctattatcactgaaaacttttctatattatcatctaattgtgaaagaatttcatagtatgtccagattttaataaggaaaagaaaaaaatgtccaaaagacagacttggaacaaagtttcagaatgaggagattgggccctaaatattatctatgtcttgaaatgaatctgcttggagtaatatattaatagtgtgtatttattgagaacatcactgcatgctaagtagactacagcaattctgtgagatacattagtttcctgggaaaactttctgacaaatgatcattttatatttgtatgagagatataattttaccttttaaaattatccttcacagttttttattagtcagggttctccagagaaacagaaccaacaggatatggttgcgttttagtgtgtgtgtgtgtttgtgtgtgtgtgtgtagagatggggggcgcagagacagagagagagtaagcaagagcaagatttattttgatgagttggctcgcatgattgtgggtgcttggtgaatccagaatctgatgaggtaagcaggcaggctggagacttagggaggagttgcagtttgaatccccaggaagtgtcctggctgaattccttcttgcttgagggaggtcagtctttgttgtcgtaaagtcttcaaccagttggatgagacccacatacattatggagggtaatctgttttactcaaaattcaccaattcaaatgttaatctctgatatgattaggctttgtgtccccaccccaatctcagcttgaattataatccctatgatccccacatgtcaagggagagatcaagtggaggtaattggatcacgggggcagtttcttccatgctgttcttgtgatagtgagttctcacaagatcagatggtctttaaggggctcttttcccttcactcagtacttctccttcctgccgccttgtgaaaaaggtgccttgcttccccttcaccttctgccatgattgtaagcttcctgaggcctccccagccatgctgaactgtgagtcaattaaacctctttcctttgtaaattacccagtcttgggcagttctttatagcagtatgaaaatggactaatacaatctcaaaaaagaaatgttactctcttccaaaaaaatgccttcacagaaacatccagaataatgtttgatcaaatatctgagcaccatggctcagccaagttgacatataaagttggccattgcaaatttactagcaattttgcttattgtttattaatattcttcatgttcttacaaaagcagttaatttactctcttcgttaggatatttaataggtcaatgcgcaggatattaaattctttttaatgagtatatatatagcagataaaaatgttgaaaactcataatgtaaggttgtaaaagttaggacataaaatgtaacttttcaaaaaagtctagataaaaatgcagtgtagggatatttgtgatttatgaggtgcatttgatgttaaaatattacagattctaattctaaatgatgacatgaaactatttctagctatttccaagaccacttccagcactaaatgtggtgacggaaactcaggggaactctctcacttagaaatttattagaatttaccaattacttgtgatgagtaatttttttttggtggagcccaggactgaagtaggcccatgcatggacctgctgacattttcccatggaagtcttaagaaaaccagcctggagtttttccatagttagattctcatctcctagtgacattttatcataaaagtaacccaggcatggttagtggccctcaagagggtaaagttcgccagtaatacctgcatataaatagtcaattatacagaagaaatggttcaaatggattcttccgaggaggaataaactttgaaatgagaaaagaacaatgcctagatattctttgtataagaaattgagggactgttgtggggtggggggaggggggagggatagcattgggagatatacctaatgctagatgacgagttggtgggtgcagcgcaccagcatggcacatgtatacatatgtaactaacctgcacaatgtgcacatgtaccctaaaacttaaagtataaaaaaaaaaaagaaacaattactagtctctaaaaaaaaaaaaaaaaaaaagtggccctcaaagcaatatcaaactggcctcctgagagtttactacttgctataaattgcctaaatttttaaatgttaatgtctgtgtcacattttgggattccttctttatgcaatgaatagctaacagctacattagtgaagaaagaggatatattgtaaattgtggggaaacctatactaatcttcccccttatgccagatttgtatttattatttcatttatatgtgccaaacactatgcagatagaatttatgggggttgtggggctttttaaacatcagtcttatacagtcaatttaagaaaatcttatgaatggttttatgtatgtatgtatgtatgtatttatttatttagagacggagtctcactctgtcacctaggctggagtgcagtggtatgatcttggctcgctgcaacctccgcctcccgggttcaagtgattctcctgcctcagcctcccaagtagctgggattataggtgcccgccaccacgcctggctaagtttttgtatttttagtagagacatggtttcaccatgttagccaggatggtctcgatctcctgacctcgtgatccacccgccttggtctcccaaggtgttgggattacaggcgtgagccactgtgcccagcggaatgtgttttatttagtaatgaaaataaagcaactggtcttatagagcagtggttctcaaaattcagaattgtttgatgggtttgttcagatgcagatatctgggtgctacaaacagtatttctgattcagtaggtcttaggtggggcctgaaatttggaattttaacaagtttccaggtgattctaatgctgctggttctgggagtagaccttgagaaccagtgctgaggattgaacacttttcagcattgtgagctattgacctcaaagaaatccctccaaagacaaatgccagattctcccttgtctaaaaagatcttaaatgataggggaaataactatttaggctattaatgcaagattgtaaattattattatgtataccatagttagataaattttcaaattttcaacttgaaagtttaggcttgatctctccttgtcaccaaataatgatgctcagagaaaaaccatgacttaaaacagaactaccatttgacccagcagtcccattattgggcctatacccaaaggaaaatcttcctaccaaaaagacacatgcacttatgttcatcacagcactgttcataatagcaaagacatggaatcaatctaagtgctcatcaacagtggattggacaaagaaaatgtggctcatatccaccatggaataccatatagtcataaaaaagagtgaaatcatgttcattgcagcaacatggatgcagctggaggccattatcctaggctaattaaggcagacacagaaaaccaaataccacatgttctcacttataagtgggagataagcattgtatgcacttagacgtaaagataggaacaatagacactgagtactacaagagaggagggagggaggggaaagggctaaaatactacctatggacaaactctttatgtatttttgacttaacgatattttcaacctatgataggctttttggaagataaactcatcataagttgaggagcacctgtatatattttactaatgtttaaagctgtagttgccttcagctgaggacctggctacataagtgtgaccctcagatcaccaacatcagcatcatctgggaaacgcgtaatcctgtaccctatcccagatccagagttcaaatctgcattttaacaagatctccaggtggttcattttcaatcaatatttgggaagacctgctgtaggaataatttcttaagaaataatactggtgatttcaatgcagaagcagaaacttttaaaacacaatgtgaagtacctgtggattggcaggctggctggggaaatcagtcttaataaggtgttacagctggaaggcagggaagagcttagctgttgaccattctgactttggtcatgctgagtttttctatttgtgtaaaagaaacccattaattaaatatccttagattctaaacagcagggagaaaaatcaattagaacaccttggagagtgggaaagaattgggaaaaattcatgatcagatagccagcatttcttgagagggaaggttaggtatgacctctccatgtcactaggtaatgatacccacccccatcctccccccagaaaaaaatcatggggaaatcactgcttgtacacaagtcatttgacacttaaaaaaaatctacaggcagtaaccattttaaatacgccttgatttctttaagtcaaagaaaaatgcacaaagtagccagtgcaaatgagaggtaaacaagttcagcacaattgttttgtcatttgtttttgccagtatttcttatgtttttccaggttctgaattaaatatggattgtccaataagagtaaatagaaataatgccagttgctgcagttgagatttcagttcagagttgcttatttttgagtcctgggggaaatgaccagaatgaatggctttagaatcttccacgcaagaaaggcagctttccatggtcagcatactcactctcctacacttctgcagccttttatccatcttgtagttggatggatccttttaaaacataaattataacatgctactcctctgctcagggccctccagggatattccattgcacttagaataaaatctagaatccttatcgtgcactccaaggtcattatcttgtccctggatccctgtcctgcaccctcttgctattcccttccactacactgtcctccttctccttgactgacaagtatgccagggtctcagggcctttgcatatgcttccttcacatgatcctttcctcagttcttctgggtttctacttcagttgcctccatgatgggatttttctgaccatctgatatgaaattgtacccctcaatcattttgtaatcaccacataacttttaactttcttcatcctgatgttgtagcaaataataatttgtttcttgttgtctccctctttcccacttcaacaagcatttatctgttttgcatcacactctatttctatgcttggtacataggaagggttcaataaatattaatgtttattgagtgactaatataatccagttgattaatccttctgttcaagcatccataggatgtcttttttgacataccatagctcagtgaatatatttgcatagtagtgtgcccctgtttccccttctgtttgagggtagagccgcaagaagaaaacttctacttatttattgcatattgctcattcctgtacatttattatgtcattatttttattcaccacaatattgtaagtaaggcactattggttttattttataaatgaataaattaagatgttgagagttgaaatggtttatccaaattcatagagctaacaaatggtggcattctttagatcgagaggcacaacaaagaaagtgaaagatagtccaaaaaccggaaaaagatgttagcaatccatataattgacaaaggactaatatggagaagaaatacagaacacttagaaatcaacttgaaaaaggtagacagccctatagaaaatggagtaaaggctatggataggcaatttacaagataatagttctgaatggctgataaacagctgatgtttcacctgactggtaattaggaaactgcaaattaaaactacaaaatatgggccaggtgcagtggctcatgcctgtaatcccagcactttgggaggctgaggtgggtggatcatgaggtcagaagtttgagaccagccagtttgaggccagcctggccaacatggcgaaactccgtctctactaaaaatacaaaaattagcggggtgtggtggttcgcgcctgtaatcccagctattcaagaggctgaggcaggagaattgcttaaactcgggaggcggaggttgcagtgagcctagatcatgccactgcactcaagcctgggcgacagagcaagactccatcttgggagaaaaaaaaaaaacaaaaaaaatcctacaaaataccatttcacactcatcagaccagtgaaagttagcctaacaattccacttgtagggaaataggaatgtacatattaaactactgcttggagtgtaaattagttgaaccgctttaaagagctacaggcaatatatctagtaaagatgaaaatgtgcattctatatgacccagcagtgatacttctaggtatgtatcaaggggtgatattcaaaatatttaacaactgctctcaggggtaccaatcaattagaacaaacatatactgtaaatgaccgggttggtcatattggtctatttcacttgaaaatcaatcctttatatgcctttgagagattcctacacacatgcacaagggaacttatctaaccatgttcactacggcattattgtaagagtcccaaactacaaataatctacatgtctatgtatagagtaatggatactcaaatagccatagaatggcatgctattcaaatttaaatggatgaactagatctacatattaataaatcagctttgataaatttcactacctattgagcaaagaagattttcaaaaagattcatatggcatgacaccatttatataaaattgagaacatgaataacaatactacatagtaaaaataaaaatacacatgggaaggatgcataccaacttcaggagagtagttaccactggagtacaaaggagggaaataggataacatagaattttaaatctctatagtctttaatttcttaacaaaataaactctaaaacaaatatgacaaagtatgaacattctgtaaatttacatatatatatatatatatatatacacctgttatttgttaaatgttttatgtatgttttgttatttaaaaagaaaaaaaattataaataacatgatggaacttctgtagaacccagatctttctgctttcaaagctggaaagcttttcactacctcggttgcagaaaagagacctagccctgctttatagtatttctcttatcaatagtgtcaggaacatggttagacaccagtgtcacaatggttagttatttgttggtcacatcccaggaggcccctgatctactgaggtacaaggtggtcaaatggtgggattcctggcaaaataacgaatgctttctttgcacactccagagtcagatgaattgggagataggtgccagactgggatgtgtatacttgccggagaccccttacttcagaggttttgtcaccactctaaacatagggctttgtgcatgcaccttttctcattttgctactgctatgtaaggcaacttctatgatgaagaacttttggctagtctgtgaagcccagctagttgctgtgtctttgctactaggtttttctttctttctttttttttttttttgagatggagtcttgctttatcacacaggctggagtgcagaggcaggatctcagatcactgcaacctccgcctcctaggtacaagtgattctcctgcgtcagcctcctgagtagctgggactgcaggtgtgtgccaccgtacccggctaattttgtatttttagtagagacagggtttcaccatgttggccaggattgtctcgaactcctgacctcgtgatccgcccacctctgcctcccaaagtgctaggattacaggcgtgagccacagcgcccggccctttgctactaggtttttcacaagagcacaaatttctcatgtaggtctaactgagggctcaagaagcatcttggtttgccatgacagcctacagaattaggtttctgaataaataatgagccttgactccagtaagtggagatcattggccctggccaaaacccagtggtctgagccatgtcttcttttctcttcacaaaactacggttgaattaggaaactttagggtttagtgttggggttgacagatctatataaacctttcaactcctagccctaccatgacgcctggtatgatcgaatatctctcaaaaaataggagccatctagatgagagcaaaaaacatatctggcaaaaaaattccatgaaacatttcctctgaaccagcaaattttgtctttgaaacatccttcccccaatggtttagtacaaatttaactgcataataataatttattttccttctcttctaagttctttgaccctcaagtaatactttgtacaatattaatatttatattttctggcatattcaatattgtattctaagattttctgaagcagccaatatgattaatatttatttagttttctatatgaactacttaaatctcaacatagaaaactgatatattaagataccatatcaatgataaatgaaaagaaatgataatgaattagacatgcagtaaataagaaaaaaaaaactttgtcatatttgagagagttatcctaaatcaatttctttgtggtttaggatgatatgaaaaataaatagtgccaagaaatatcttcatcttatctaaatcgtaagtgtaaaagtcaacatgtatttttattgctaaaatgtaaatatctaaatatgataatgatgatagtgaaactgagtttcatgtaaaagtgttttgggggcaaataaatttaagtggtataatttgtcttattttagacatgaaagtttattaattgaacagcttcagattttataaagaataggcttggtagataatgatgatatgcatagtattgtgagtgctatccttcttggaaaatggttattaaaattcattagaagtagctattgcttgtcagatgattgtataaaagtttccaaaaagaatggggtagataaaatgtgcgataaaataaataataatgtatataccaatgaattgattatccagatagcatgaaaatcctcatatttcaaagaaatgctaaaaaagaactttaacagtctctgcatgacaactagaagtgataactggattcataaaataataaatatatatgagctttcttcataagaaaaccaatgtaatactatagcttctacagtcccctttttctgaagattaccttccctcaagcatagggttgaggtcctagcagctatggttgtgctagagggctctgtcaccactagccctctcacccataacacttgattggaccatgagtagatacctgatccaaagtggagcaatcagttcctctcataaagaaatataaacctggagccagacattctacctcaatctatattgatagcattgacagaagtaatgtagatcagggagctatggaatcagccatattccatcacgtgcatgcagaaacagcaaaaggcactttgtagagggaggagaatgaagcagacaggcagagaacagcagaggtcgaaaacatacatcttccacagatggaccaaataagtggaaaacatacatcttccacagatggaccaaataagtgtcctccccatgggaacaactccgaaaacaaaaggatcatgtttttgaaattcttttatttatgagacattaacatttataatttgtgagtgacaactaggtggaattggcctgtaccattatcttaccattttttgttttaaaaaacctattgagtataatactttttatactggttgctttatatgtatatcatcaagtcttcatgaagcacaggttaaaatcaccatccatattttagagctgagtaaaccaagacttagggcctttatttttattttttttgagacagagtctcgctctatcgcccaggctggagtgcagtggtgcgatctcggctcactgcaagctccgcctcccaggttcacgccattctcctgcctcagcctcccgagtagctgggattacaggcacccgccaccacgccgggctaattttttgtattttttagtagagacggggtttcaccgtgttagccaggatggtctcgatctgctgacctcgtgatctgcccgcctctgcctcccaaagtgctgggattacaggcgtgagccactgtgcccagcctaaaatcaccgtccttattttagagctgagtaaaccaagacttaggacctttatataacttgcccaaactcacgtaactgactgcagctggccaaacagagactcaggctcaggtctttctgactccggagactatgcccttaactattatcttatgcttgaatctggaggcagcaactggtatcttctgaaaaggaaagggggagatctttttcccttatctacatgaacagtaagttcagcttactctgcatactgtgcatgctgttccgagctctgaatgacagaatgaggtttgggggaggtaaaaggcaggctatgtgttttcagctaaactggacacacagtgtatgcatgtgtaatatatgtgtatgtgttgcacacttgtgtatgtgttgtagaagggtgggtaaggaggagacccttttccagaagtagaaaacacttatcccctttagttaccatcatttaacattctcttatctgtgagacagcagagttaaattagaatgaaatgtcatatggtacttgatgggaaggcactataaaatagcgtgtgtgttacaggaagggcctacaaagagaacaaaaacagaaatgcctgggaagggatatgacaaagccacatttattgattgcagagaaaattaaaacatttatgtaaaatggcatataggttctcacagggcataagcctaaagtcagttagtttggacttcagagggattttgctgaatatgagaaatgggttccaattgaaattttaattaggaccccagaacacattggtatacttactgccaaaagttcgccacatattgcaagcttaggaagattggatagactttatttaagctgggtaaacatcatcgcagacattttaccccattggaagagctagaagaaaacagaaacagaattttgcagtaggagagggtatctgaagaggggactgacatttacatgaaatgtgaaaacaatgacgggcttttggtattgtctatgtgctgtgtgaggagcacacagaattgaagattgtggtagttttctgaatttgaatggcactgaacagctttagcagcaattggaaagtgaaatggaagagtcagcataaggagagaagaccagtcctcctttcatcttttcattatagatttttatccaatcaatacaccaagaaattctgaattacctttttttttttttaaagggaaggacacttgggttgcaggaaaggaggagggagggagagaaatgtttttgctgactttcacaatattcttgtagaaatacttgctcttctatttttttaattggattttcaggcttaggtgggaaaacaaacatggcccatcaattcctgtctccatattcctcttctatatgaaaaggttttttaaaaaattttccttgtgttcatgagaagattcctattgctttgggctatatatctccattaggtagaattgttcaccctgagcccctctaggctgttgattgcaagaatttctccggttggctacatttcaaatctgtcagagccagtgatgtattccaggtgcagccaagtgtgaatgctgttaacgctattggatcagatgaccttgatattgggtctcttcatgactgcagctcaagttttctactctgcttgtttctcacttcttcctctaattgctgctgactgttcaaaagctgggcttgtttgatatgcttccaatttttataaaattatagtaattccctatagaatcctgtgttttcagtgtccccattaaataaacatccaagagaagagtttaatttgcttattatagtcaactctcatccaaataaagtatacctcattggaccctcttctcaatgatggaaaattcacagcctccacacaaggtattttatggctatttttccaatttatcagttaggatactttgggctgccagtaatataataactaataatgacttaagcaataaagatatctgttgctttatataatacaaagttcatagataggggattcctgggtatattgcttgggtccaatatttactgggggtaacacctatgaaagataaagaggaaaagtatcaagaggtcagggaaatccttctgactgcagctcagatctgatacctgtgaaagtagaaggtaaagagaggaggactgggtaggaagagcctaaaactgcactgaggctctgagaaatcagggtgagcctaacggggagctctgctgcaaatatggcccatagaagagtccagtgttgggcagaaatgactgggccccagtgtctcactgtgctcagctattggttgagacttcctggaaaaggctagccttggctcagatgctgccaaggattgtctgcagttgggggctgtcagctaactgcactccacacagctgatcagcaagctttttcttgaatggagatgagctgcacacctccatagctgccacatagagtttaattcagcagcacagttatgtgatccagctgctttccaaatctccatgtggtcatacttagcatgctagtattcttcttcaaatttatttctacattgtctaaaaatgactgtcacagcctcatatcttcacacaactgtacaaaagcaggaaggacctcacatgtctctgtttgtaagggagagagatctttctctaaaactgccaagcagactttcctgtcagtgccgtaggccactttcctgtcacatacccatgctttatctgtaaggcaggctaggaaagtgaatgtctggcttttgtaacctctataacaggaagtgggttatgccagcaagtaggaagggacataagagggaggtggtgggcgtagctgttgggtaggtaaaccaccagtgtctgccaccctaaatatggctaatgtggcacttcataattttattcccagaaaaattcagattttagaagttataaattgagcctggatttatgacttgttacactggcagtttcttttgcttatcttgcatgccccaaatattcgtatcccttcccccagccagcagtatgaagcttcactgcagtctttcttcagatcatttcttacttttcttttattgttgtcatggttctgtagtttactaaatgccacgtgagcagatatccaaccaaaccatttagactaatattttattttattttattttatttttttttgagacggagtctcactctgtcgtcaggctggagtgtagtggcacgatctcagctcactgcaacctctgccctccgagttcaatcgattctcctgcctcagcctcccgagtagctgggattacgggcgcctgccactgcacctggttaatttgttgtattttttagtagataccgggtttcaccttcttggccaggctggtcttgaactcctgacctcgtgatctacccgccttggcctcccaaagtgctgggattacaggcgtgagccactgcgcccggctagactaatattttaaaaaggacttgtgaaaagtctgattactcagtgattgtaattctctcattttaagctttcagtttaccatgcgggtttctctagtgctagaaagctgcagagacgcttaaggcccgagaagaagagtggtaaaaacattgcatagtgtgaaaaatacctttacagggttcttattttgctgtaaactgagatgtctgtgtgctttgcctaataatgtctttctcatctctcctatatttctgtgtactctaggtcgcttcttcattgaatctataattttcagcacagagatagcaagctctacttactcactttttgaatgtgggaaagttatgcaacctctctgagcattagtctcctcatctgtaaaataagataaaagtgtcccttttatgtgggtgccttgtgtaaaagacacaaacaacatatattatttcttattataaggtgaggtgtaggccaacaattgtcaacagacaaaacaagtaacagaaatagaaaagtttacttttgctcaatgaaaataaaataatgtacttattttcattcagctatttactgtgctcctactatgttcgaggcattgtttttagcacttaagatgcagtgttagcatggacacacagaggggaacaacacatactggggctttttggagggtggcgtgtgggaggagggagaggatcaagacaaataactaataggtactaggcctaatacctgggtgatgaaataatctgtacaacaaactcccatgacacaagtttacccatgtaacaaacctggcacttgtaaccctgaacttaaaagttaaaaaaaagatgcagtgttagaaaaaagatatctcctattagtggcatttacatttaagtgggggaaagacaagagatgcttgtattttaaataccctcagatacaatgcctgttgaattaatttctgcagtcatttaattattcattaagttacttttgaagcagttattcaaaagttatgcttgacgtttttattataataaaagtaacattgttttatagaaattttagaaaataaggtaaatattaaaaccatctagtggccaggcgcggtggctaacgcccataattccaacactttgggaggccgaggtgggtggatcacttgaggtcaggagtttgaggtcagcctggccaacatggtgaaaccccgtctctactaaaaatacaaacatttgcctggtgtggtggtgtgcacctgtaatcccagcccctggagaggctgaggtaggagaattgcttgaacctgggaggtggaggttgcagtgagctgagatcacgccactgcactccagcctgggcgacagagtgagactccatctcaaaaacaaaaccatctataatcccataatgtagaaaaccatggttagtgtgtgtgtctatgtgtgtccatttcatttgcttttgtttatatagatatatggaccaatgtagttttctaaaaacaatcgagatcattttataaactgcttttccttatattttaaaatatttgttaagaacatgatttctgctattccaaatcaagaacagatatgctacaatttaactagtatcatatcattggaccttgaggattaaaaaaaattatgttaattaacactatgataaatagccttgtttataaatactggtatgtatatctgattatctctttgggataaatgtctggaagtaatattactgagccaaaggctgttaaacatatacagattatacgtataatctcaactgtcccttcacagaatagaattaaatcgaattttaatttatcagtgtttatttccctgcatcctttgtagcattagacccttaaaaagaaccttaacccaatttgttagagaaaagttacatattggtttaattttaattcctttgattataaagaagtcaagcactttttaatatatatgttgttcacttgtctagtgagttgccttttacatttcagcccatatttattcatcttttactttttctttgtaaaaagctccatatataaaatataaataactatgatcatattatatattttaaattatttttctggtgtttcctttgcctttgatgatattttcaacattaagaagattttcatttttactttatcaaacctattcatatttacttttaattttctgtggttgctttactgttttaaaattattttccacattgatatcagaaattatttctctctataaacttgatgttcttttgttttttataaaagcaataatcttgtgggaattattttctaacagtaagagttttttggttgatcaattgtcctgctatatattatgtatttttcatttatttattttacttatttggtttggaatagatttttctttcttcactgatttaaaacggtctacctttattgcctactagattcctatgcagatagtgtaaatgtcaacattattctttgataacaagaactgtaactgcagaagttttggaatgaaggagagtagataggaacttagggaagatatggcactttggctggacccagaaagataaaggtgatttgtcttggcagagaggaaagagaaagggcattccaaatgggggaaaacagcttgagcaacacccagaatagttaacaagtattatatatagtaggtgatgggagagggaaggtggaagggacctaatatttgttgaatgcctactgaatgtgagtcaccatgctaagaatcttatgcacaactctgaggtcagctgaatcctcgtactttgagtcctgtgtatattcagagctttgctttccatctgtcccaatttgtatgtagaactaagtatttctttgaatttctgaaacacagtttacttacacaaaaacttcactggtcaatcaatgcaatcagtttcttgacctcaacactgtatgttctggactgaaaaatccattgttttaagttactgtgctgtgcattttaagttgtttatccttgacttctacccagtagatgccagtagcaatgctgccccctagtagggacaactaaaattgtctccagacattgccaaatgtcccttagggagcaaaatcaactccagctgagaaatacagattataccaaagaaaggaaagttagtggagggttttttttttttttaacagagtcttgctctgccacccaggctggagtgcagtggcgccatctcagctcactgcaacctccgcctcctggcttcaatcgattctcctgcctcagcctcctgagtagctgggattacaggcacccgccaccacgcctggctaattttttgtatttttagtagagatgggggttttaccatattagtgaggctggtctcgaactcctgacctcaggtgatccacccgcctctacctcccaaagtgctgggattacaggcgtgcatcaccatgcccagccagtggaggattttgtattgcgcagtgcacaacaaatgaatatcctctttttgttttccttcataaagtcccttcttggcttctctacacctaggtttgcgcttttatttttgcttaatccattgcaaggtttctcaactgtggcactactgacattcaggccagataattctttgttttagggagctctcctatgaattgtgggatgtttagtggcatcctccgactatacccaggagataccagtaccaccaccatcacccccagttatgacgactgatatggtttggttgtgtccccacccaaatgtcatcttgaattgtagctcccataattcccatatgtcggggaagggacctggtgagaggtaattggatcatggggcgggtcattcctgtgctgttcttgtgataatgaataagtctcatgagatctgatggttttataaaggggagtttccctgtacaagctctcttgcctgctcaccacataagacttgcctttgctcctccttcaccctctgctatgattgtgaggcctcctcagccatgtggaactgtgaatacattaaacctcgttttctttataaattacccagtcttgggtatttcttcatagcagtatgaaaatggactaatacagtaaattggtaccagtagagtgaggtgctgctgtaaagatacccaaaatatggaaatgactttggaactgggtaacaggcagaggttggaacagtttggagggctcagaagaagacaggaagatgtgggaaaggtttggaacttcctagagtcttgttgaatggctttgaccgaaatgctgatagtgatatggacaataaagtccaggctgatgtggtcacagatggagatgaggaacttgttgggaactggagcacaggtgactcttgctatgttttagcaaagggactgatggcattttgtccctaccctagagatctgtagaactttgaacttgagagatataatttagggcatctggcagaagaaatttctaagcagcaatacattcaagaggtgacttgggtgctgttaaaaacatttagttttattcattcagaaagatatggtttggaattggaacttacatttaaagaggaagcagagcataaaagttcagaaaaattgtatactgatgatgtgatagaaaagcaaaacccactctctgaggagaaattcaagccagctgcagaaatttgtataagtaatgaggagccaactgttaattcccaagacaatggggaaaatgactccagagcatgtcagaggtcttcatggcagcttctcccatcagagatctggagcctaggaggacaaaatggtttcatgggctgggtctagtgttcccctgctgtgtacaacctagggatttggtgcccttcgtcccagccatgccacctgtggctgaaagggaccgacatagagcttgggctgcagcttcagaggttgcaagcctcaatccttggcagcttccacgtggtgttgagcctgtgggtgcacagaagtcaagaattgaggtttgggaacctttgcctaggtttcagaggatgtatggaaacacctggatgcccaggccgagatgtgctgcaggggcagggccctcaaggagaacctctgctagggcagtgcataagggaaatgtagggtgggagcccccacacagagtccccactagagcactgcttagtggagctgtgaaaagaggaccaacatcctccataccccacgatggtagatccaccaacagcttacaccgtgcacctggaaaagccacagagactcatttcgagcccatgaaagcagccgggagagggggtatactctgcaaagccacagggacagagctgcccaagaccatgggaacccacctctcgcatcagcgtgacctggatgtgagacctggagtcaaatgagatcattttggagctttaagatttgactgcccagctggatttcacgcttgcatgggcctgtagctcttttgttttaagcaatttctctcatttggaatgggcagatttacccaaggcctgtacctccattatgtctgggaagtaactaaattgcttttgattttataggctcataggtggaagggacttgccttgtctcagatgaaactttgaactgtggacttttgagttaatgctgaaatgagttaagactttgagagacagttgggaagccatgattggttttgaaatgtgaggacatgagatttgggaggggccagggacagaattatatggtttggctgcatccccacccaaatctcatctcgaattgcagctctcataattcccacatgtcatgggagggacctggtgggaggtaattgaatcatgagggtgggtctttcccacactgttctcatgatagtctcatgagatctgatggtttataaatgagagttcccctacacaaactctcttgcctgctcaccatgtaagatgcaccttttgtcctccttcaccttccaccataattgtgagacctccccagccatgtggaactgtgagtccattaaacctctttttctttataaattacccagtcttgggtatttcttcatagcagtatgaaaatggactaagacaacaacccaccaaatctttctccagacattgacaaaattgggcctggtagagaaccactgatgtagactacaccaaagacaggaagtttgtagggatactttttctctgcaaaacccgcaagatataacttagaaaccctctattttttttttttctttgacgtgcctttttggttactaagcagttggttttggttgtttttcttatgctgtctcaggggttccccatctcagcactattgttttgtgccagataattctttgttgtgaggggctgtcctgtagattgtagggtgttcagcctctacccactagatgctaggagcacctcaccccctacccatagctgtaacaaccaatactgtccacagatattgtcaaagttccgctggggagcaaaatcacccttggttaacagtcattgcactatttctacttatctttctctatacactggttcttctgtccagcattatgttgtagaagaaatgcatacatctctcatttccttactcatagacattgagtgataatttttcttgttaagtgttacttacacatgattatggaaatatactatctcaagtggttgagttgttgcattcttttctaacaaatatagcattgcccctaagaataattctggaaaataacatatactctaacttgctaaacatttatcatttctcctcttgagtgaacagcactaagccatttgagcttctattacagttctgctatagattgcctttgcattaaatttgcacacacttctctatttcactaaatctgaacttgtagagaacctcaagacaagcatattgcctttaaacataataactatactaaaattaaaaaatataaatattggaatcaggcactgccgggtcaaaatatcccttaagtcctctaaatatcacttaatttctctttaatcaggtttagggcccttaggcaagttagctcctctgactttgcttcatcccctgcaaaataggggtaagatttccttccgagtggcgttcttataaatattagagattaggagataaagcgccaggtatgtatcactcaacaatgttaaccattgttattaattttatccagagatattaaggtctacattttaaaaagcctttaaagtctatactttaagccttaaatacctatacctagaacatttacttctttctttcccttattttctgacttatttgtagtcacaggtaaggcatgctggggaaaaaagtttgttgccttaatttttctcttgattttaccagaaatgttaactaattctaatgttttcatgaacactgaattttaaagtttacttaacatctttgtagggatttctttttgcaggtgtgagaagcaccttgcttctaaataaggcataagaggtagaattatagataaaattaggaagagttttactaaaattggttcttatggcaaaaacgtcatttggttttttttttggtttttttttttttgagacagagttttgctcttgttgcccaggctggagtgcagtggcacgatttcagctcactgcaacctctccctcccgggttcaactgattctcctgcctcagcctcccgagtagctgggattacaggcatgcgccaccacacccagctaattttgtatttgtagtagggacagggtttctccatgttggtcaggctggtcttgaactcctgacctcaggcgatccgcccgcctcggcctcccaaagtgctgggattacaggcgtgagccaccgcacccagcccttatttgattggttttaatgtttttcccagtagataaatttttctttcactttaattttttccccgatatatgtatctatatatatatggttttgaccttcaaattgaattaaaataaagcatgatgaaaagaaaagcaaagaataaaatgaaaacctaccagttaaattgcaaaatcaataaaaatgcagaatgcactattcttgtcattgaaaaggattgttttattcaattatacaaggatgcaatttcccctagattagacaaaaaagtgttaatacaaggctggggtatacagttttagttataatgtcaccgaattttagaggtaaaagagacctctaaattaataaaactgtcccattttatgagtagagaaattgaggcctagagaaggcaagtgatttcctcagagttttaaccaagggttagtgacaaaatgcatacaaggacctgaatcccagtgagtcagacatcctgctctgctggtgacatcattctgataaaaatagaattgtggaatcttctaaaaaatttagcacttattttctaatgaactaaaacaagtagagaatgatagtggaaataactttaagaactgttgtggcaccaactgctcgggggaaaagagaatactttgactggataagcttgaagctatgcttcaatttagtacaactattttaaagccagaaaagcaccattgttgtcttctaccaagtgttttagagaagacaaatggacatggtagactataaaattaacacaagaacagaaactcaaataccacatgttctcacttataagtgggaagcaaacgatgagaacttatgaacgcaaagaaggaaacagcagacactggggtctagctgatgggggagggtggaaggaggcagaagagcagaaaagataattattgggcactggtcttaatacctgggtgacgaaataatatgtacagtaaacccccatgacacgtgtttctttaacaaaccttcacatatacccccaaacctaaaataaaagtatttttaagagaaattaaactttaaccaacacataacatttactttctcttcacatagtctctcactctctcatttttgagacttttttaaaattaaggaacatacacaatattgaaagttgataaacccccatgacacgtgtttctttaacaaaccttcacatatacccccaaacctaaaataaaagtatttttaagagaaattaaactttaaccaacacgtaacatttactttctcttcacatagtctctcactctctcatttttgagacttttttaaaattaaggagcatacacaatattgaaagttgataaacccccatgacacgtgtttctttaacaaaccttcacaaatacccccaaacctaaaataaaagtatttttaggagaaattaaactttaaccaacacataacatttaccttctcttcacatagtctctctctcatttttgagactttttctaaaattaaggaacatacacaatattgaaagttgataaacccccatggcacgtgtttctttaacaaaccttcacatatacccccaaacctaaaataaaagtatttttaagagaaattaaactttaaccaacacgtaacattcactttctcttcacacagtctctcactctctcatttttgagacttttttaaaattaaggagcatacacaatattgaaagtttagcagtattatttaagaattagttatgtcttcaaatggctagtatgtttccaatacttccttacatatattcaatactgcatatctttaacatgcctggaatcttccagtagcctggtacaacttttcaacttaaaaaataaaactccttgcgtctttgtccaggttttcttgatcgtgtttctctgtgcctcttttgttgatttaacttgtattgctcagccattactacaagatcttccggaacactctgatttgctctgtccagaattttaatcaattcaccggccattttcgaatctctctgagtgatgagggtaactgatgtgccagtctttcctgtccgtccaatgtaccctactctgtgtacatatacgtcaatattccttgggaaatcataattatatacatgtgtgacatcattaagatcaagacctcgggatactatatcagttgtaatcagtatctttatgtttccgcttttaaagtcctctactgctcgctcttgatcactctgttcactgttgccatgtaatgattctgcagatatgccttggatattgaagtcgcttgacaagtcatcagcaatatgtttttggctgacaaacatgatgactttgtcgttgggtgacatgttctctacgaattcttgggtgagagctcgtttttctttttctgtggtaacaattatattttgcttcactgtatttacagccactagattcagattaccaacataaacaatcataggatctttcaaataagaaagtgctagttgacgtacagtatctggccaagttgcacttgtcataacagtctgtcggtctgggcgcacatctaataaaatcttccttatctggggttcaaattccatatccagcattttatctgcctcatctataaccaagtaggttatgcttcttaggttgacagagttattcatttgtaggtcattcagcctcccaggagttgcaataatgatatctacacctttgctaatgtcttctatttgtccatttctgtttctaccaccatatatgcaaatgcttttgagacctttatatgaatactttgaacattcagcttccacgtgaagagccaactctctagtgggtgtaaggactagcatcccaggcccattcctttgctctctagatattggttgagaatcaagatgaataaacccaggcattagataggacaatgttttccctgttccggtttgtgcaactactataagatctattccttgtagaataattggccatgcctgtgactgaattggcgttggctttacaatccctacccttattatgcttttcagaagatcagggtattgctgaaaagcgtctttaaacctgcaagttggttttggaatgagacgcttttcaccacttttcaagtcatcacacgttatgttgaaattttcctttctccagttaatcacctgcatttcagacatgcagcttgttgctttggattctatgtaaaagtttttcttaactggtggtagatctgcccattttctcttttcgcactccacgactgctgccctaatgcgatcccaatttgacaatggctcagcttctccaacaatgtcatttctgcctagatttcttccaataggggtttgggatgcagcattatccacactggattctgagttgtagctttcttgttttctaataagtgtttctatagccgctttggcctttgctttcatttccctattgccaaaaattctgacttttgcttcagattccccgtttatgatctgtattttagtgtttgtcgaatgttgtagatcttttatttttgatccactgtaaccaatgaccacaccaaccatattgttctttattttaaagcagagtggtggttcacgggagcctgctgctctcggtccctgatggccgaaggggccactccagccactgcctctgctgcccctgacatcccagctggccccaaggtctcttggattagcctccgccctcttccactctggggcccagtgggacattgtgggatagtgggagtatcggcaccggcttctcgcctacatacggttggaagttcaggtctgcggcctgtttcccgtcaccttctgcaccaaaagatggcggtggcaattatttccgggtgctagtcacatagctacgcagaagttgccccagaaaccagtgttggcgtcgaattccgggtcgtgtagggggcgaggctttgatggcctgaccaatcacagggcttggactggggtgaggtaagcaggcgtctgtgacgcaaatttaaagaggcactcactctcacgggctgaccctgccagcacttacaggaccctaggagtaactgcctccttaacttctgcgtcccgggtgctcctttcactcttctcgtgatagttctggctcagcttgagagcaaccttgaagcacgccttaaacatacacaccatatacacattgtcctttatataagccagttatttccctaagagaaaaaaataatgcatttaaagtaaaactatttatttatatattcgtgtgttcatttattttggtaaatttcttttggagtgaatacagtactttgtcaggataaattcatcattccctgtcctctagtgtaacttaaattctactaatcagaaatctcttaggtgcacactctaggacagcgttttgccttaattcatcaactaaatgtcaacacttgtttaggcagtttccagatattattacagggatgatggttagaagagaggtaaagcagtgcctaaggtactttaggggctgtttttagtggtttgtcacttttctcagtgcctcttcattttttttccttccctgtggtttgatagcttctgagaccttagcactggaaggttgtgtagaactcatttattaggtacacgtagaagacattctagctgcagtctggacagagggatatccagcttccatttagacactcccagaggcagggagctcacttcatttcaaaaatatccattccattatgaggctgtttaatggttacaaaagttttttgaaccaaaacgtgcggcttcctgtgtccttaagtccttctgagttctgaagttatacagaataggcttgattctcctgtatccttgtgtactaaaggatctgtcaaagttttcttttttttctttttcttttctttctttctttttttttttttttttttttgagatggggtttcactcttgttggccaggctggagtgcaatagcatgatcttggctcgctgcaaccttggcctcccgggttcaagtgattctcctgcctcagcctcccgagtatctgggattacaggtgcctgccaccaagcctggctaattttttgtatttttagtagagacagggtttcaccatgttggccaggctggtctcgaactcctgacctcaggtgatccacccgccttggcctcccaaagtgctgggattacaggtgtgagccaccgcgcccagcctctgtcaaagttttctgtgcatcagggcaacatttccagtttcttcgacgtttcttgctatgacatggtttccaagacacacatcatcctattgcctctcctttggaaatggttcattgaggaccatttacaatgtagcacgcagaactaaaaaacaggaaaagacaagcaaacaatctgcagaaatggcattactcctactattagggcatctttactgagcatgacaattctactaatttgacctaagaactcctgagacacaaagctgctcacagtaacatgacgtgcatttaagttcttgcttcttttacttactcagctgattttttttttaatttgcttacctaaatgaagactatgtatgtatccttttatagtcatcttattaagtttgatcaattgatgtaacctatgaaatataattttaatgattattctgtcatccatcatattagtctctagtttcaagtcttctgccaatttaatgttcatagcatctttgtctctttagtcagtcactgattaaaatttcatcatggtctagtataggacagaagtctgacaccttgggagaaaacttctctgtgtcagtactttttgtaaaagatgctatttgaagaaataaaaaggtttctggtcaaatatgtttgagaaacacagcaccctatattctctctgttaaaatcacaatgcttattggatattttaggagctatgatatttacagacattgagaaaaatcagttgtttaatccaaagttccccaaacgaatttgctaatggatatcttcatcaattatttaaataagctttttatttggaataatttcagattcacagaacagttacggaggtagtgcagagaggttcctgtatagcctcagccagtttcagtttcctctaatcttatcatatctcattatcatgatacatttgtcaaatataggaaaacactattggtgtgttaccattagctaaattccaaactttatgctaccagttttccattaatgtattttttcggtttcaagttccactccaggacaccatactgcatttagttatgtacagtttgtgagagtttctcagttttttcttatttttcataatctttccagttttgaggagtaatgatcaggaattttgtagaatgtccttcaaaaaggtatgcttgatgtaacttctcatgattagactggggttatgggcttttggaagaaaatatcacagagatgaagagcctatctcatcacatcatactggggagataggtacctgatgtcaacgtgacccatcattggtaaggtcaacctcggtcccttggataatttgtgttattcaagttttctacactgtaaaattattatttctccctttccatactctattttgtggaatgagtcactaagtccagacaaccctcaagggctcagtttgcatttaaatgcaatctttattattattttttacaattagtagtgttctttggaatgtattttggaaaccactggtatggataaatacaaattacctgaccaatttttttttttcatctggttgttgaaccggatatattctgatcaagtcacattacaactcctccatacttctccatgaattgtattaggaattttaaggcattctcaatgtcttctagtttattcattattttaaaaggaaatttgtttagttacacgtggcttttacctcttgaaggatgtattatgtttctctgtctttatgccttcatctttactttgaataatagttaatattacagaactgtagaattctacaggtgttgggtacatcagaggtcattttgttctcccttattacagagagtgaaattgaggttccaaaatctttctggaattgactgaaggtactcagcaaattattgagagtaaaaatttagaaccatttgttgacttgtggccagtcgggaaaatagtacaggacattactcctttactacgaagtgacttgcttctattcttattttttgtgggtgatacagaaaaatagaagaggccatgaaagtgaagtgaagaaaagtcatattgttgggagaggggtagttgtaaaatctgggtagagagcagtgcactttaaggtggaactcattgtggtgaattactgtgatgacacagaactggtagaagacttgtgggtattgaagatactgagagggattgtgctttcaggatgattcattaccatttacaattgcccgtatcagttggaaaaaatatttgtcagctcaattaagggccaccagtgtgatgttctttgctctaaatatctctacaacggccttattcactgtatctgaaatattctcactaaatatgtatctctatggcttatggcttggtatgttattagcatggtcctggaaaaacaaaacacaaaaatgtgaatttgtcggttagatgctttccagtggaacagctggctaaaagattcttttagggcagagagtgggaaagatgggaagaatgtgtaaagtttcccccaaggtaagataaaaagggttatgtaaggaaagacaagagtatgtttaagacggtttctaccattttgcttagggcagtccctataatcttagaggcaacagtaagagagtgaaatattgcaggcagtgaattgggctaatttgccatcactccgatttcttcaaaactctcttaaagatgagttaatgttgctggcctaaaatagtctcatatatgggactcccttagaaatgatagtgatagtgttttatttaataaatctgctgtgatggtctaaggcaaacttgacttatggaattccagttagcactgttgatgataataattacagttggttttgcatctgtacagcactttacaatttataaatactctttatggaagtagtttccttgggatgatatatatctggccattattctgttcaataggtgtgctatattatggcaaatgttgcaattatcattgtacatattggtatgtttattttgtatatagaatcatactcataccacagagtctaaagaagtagcagcagtgtggtgtagttagcaatcaagaacactggaccttaaataactgggtccaaatatcactttcaccatttattcactgtgagtcatgagaaaattgttttagttttgctgtctgtagaatggcatactagtacctgtctcatacacacacacaggcacacacaaagttttactaattggttcatagtaggaactctccaagtatcaattatccctgttacagaaacagtaggtatagagagacaatcatggagattccctgtccaaggattttcctgatagcttcctctggtccatatcaaaatgaaaaaaaaaaaaaaaagaaacaaacaaacaaaaaaaacaaggataatagaacttttttacccaaatctaaatttattcaatgtaaacttttttattctaacattatgccctactatcttttgtaaaatatacttttaaaatgaaataaggatttcaaattatttttaaaggtctctcctagggcaagaaagaatgtaaatctaatggccagtagcctaattaggctttgaaatgttattggtgtatgaaacccaagtgcttgtaagcactgatgtggaacatcgaatgtggtttgaatgtttttgttcccccgaagttcctatgttgaaatcctaaccccaaaggtgatggtgttaggagatggggcctttgggaggtgactcggtcatgagagtacagctctcatgaatgggattagcttgcccttgtaaaacaggcctgagagaaaccccatgccttttttgtgatgtgaggttacaatggaaaggtggccatctgtcaaccgggaagcgggcccttaccagacaccaagtctgctggtaacttgattttggacttcccagactccagagctgtgagaaataaattcctgttgtttataggccatccagtttatggtgttttgttatagcagcctggccagactaagacaattagcccaacaaacacaaattagaatgctattaggtgttaataatggttgcaggcaagaagggccgaagggaggttggagaggctggagagttgaggcaaagacctataaggggagtgggtttgatctgatactataggaggtatgaaattagagatagaaggatgttaaagtttcagggaaaaaaaacaagtgtggcctttgggaagaaatcagggcagcctggaggactaggacaaaaaattcaggttaaggagaaaggggaaatggagaaggatggtttgggtcaggggaaaggaaaagggaacttttaggaaccttaaggacagtcaatgaactatcaagttaatatggtaaaacagtgggaaacttagaatgaaggagtcatatgacattaatgaaggaagtgggtccctttggagaaagtagaatgcagggaagtggggttgaaaaatgggggctttgtttttgatatctcaagtacatgggactgagggacttgaacagagtgtggtagtttagcagtgggaactcggagaatggaacagatagaaaaatcacgtctgagaagcaactaacatttttgagttctactatatgccaaacattttaagtgtattatctcattaaattaccacagcaacttcatggtatgtattttccgtctttttcatgtgaaaacattgaagctcagagatgttagataatatatccaagttcatgcaaagttacggtaaataactttaaacatgaataaatttaaacgtggatatggttagcttcaaggtcttttcccttccacctaatcctagtttctagggaaaaaatgtgcttgatttggtgcctggttctcagataaaaagagtctttaattaaagatgactcagtcttccaggttagagacttattgaagcagagaatcttgaagccattcgacaggaaaggcggaggggaagcagaggagtttggtttcagtcatgtccagtttgtggtgttgtggggggcatacaagtaaaaatgctaactgaacctggagatttgggactgtagttcagatgagaagacgaagagagatttgagaatagtcagcatagaagttatagttgaaactctaattgaatacttgaacaaatagacagtagtgaaagacaggtttaagaacattttaaggaaccatagaattcatatgattagataatgagaagagaaaaacaggaaggtaggtgaagagagagtctacatagtaggaaataaggcaggagaacttgtcgaggagttttggtaaacaatataaaattcttcagaatgacaggagggaggtagactactcagttttggagatgaaaatcatcaatgaccttcaagaatgccctttttggcccagcgcggtggctcacgcctataatcccagcactttgggaggccaaggcaagcagattgcttggggccaggagttcgagaccagcctggccaacatggcaaaaccccatctctactaaaaatacaaaaattagtcgggcatggtggcatacatctgtcatcccagcttctcgggaggctgaagcaggagaataacttcaacccgggagatggaggttgcagtgagctgagattgtgccactgcactcccacctgggcaacagagtgaatgactccgtcttaaaaaaaaaaaaatgccctttttgtagaatgatggagaaacacgtattttaagggaaacaatttcaatgagagatgactagaccactggggaactttgtagtgatggagtgagaactttatgtatcttgtacctgaagctcaaaggcaatgtcttaattttaaacaatgcttctagaaaacaagactttcggggacaggttattgcaattgttctggtaaggatccaatggacttcaggaaaattacttatgaatattggaagaaaatgaactttaatagtctttggaaatatgtgggaggatatacaatgagagagggaatcacaaggatacaagaaccattcattagcagtttcagaaaaggaaagtctgtttaaaaggagggaggagagtgctgagagttctttcaaggagattacagtgctatctttagctacgcattaaacttttctctatcaaatttagtttattctccacagaataggggtatgcattatttaggtatgtgaagaagtgaggttactgaagtaattaattcttttttcagcacagacagtaaaaaatagtgtgagctgattagcacctgcaataagctccttcagagaaatccttgcttaccaactacttcctatagaaatgttaacatattggtattcattttaaaaataataataaccttgcctctattttgaggcatttgaagggctttccagaactatttcatttctgataactatgatgtaggtaagtagaaagataaacaagattatctatatcattttgcattgcataaagaagtcaaacaacaattcttaaaatcatggggttgtagaggtgtaaaggattgactttggagagcatctcttgtaaagctttgatttgcaagtgcaaaggctaagatctacacatggctctgtccaatagataatttttaatttgtatttttaaaagtctctcaaaatatatcctctctcctaggtgcttttaaacatttaaagaggaattaacacatattctacaatgtttttattacagaagatagaaaaggaggagggaacacttcccaacttattttattaggctaatagtaccctgagactggaaaaagacaaatccagtacaaacaaagagaaaactacagaccaatatcccttatgaacacagatgaaataaaacctcaaaaaaagttagcaaatggaatctagcaatatataaatgtacatccatacatatgtatatacacacatatatacacacatacaccaactggagtttatttcagggatgcaaggctgtttgaatattcaaaaatttgtcactttaataaaacactgcattaacaggctaaagtagaaaaattgcatgatttcatcaatttatgcagaaaaagcatgtgacataattcaacacccatttatgataaaaactctagccaaactaggaatagaggataacttcctcaatataataaaggacatttacaaaaagaccacagctttttgtactttgtacatgtactttgtaacagtaacatggttaatagtaaaagtctgaatactttacacttaagtttgtaaacaatgcaagtgcaggcactttcaccacttttattcaacacactactgaaaatcccagctagagtaataaggcaagaaaaagaaagaaaagcatgttgattaggaaagaaacaataaaattgttcctattttccgatgacacaatctacatataaaatttccaggaatctacaaaaatacctcctagaactaacaggtaggttcagcaaagttgcagagacaaaatcaacatacaaaaatcaattgtatttttcagactagcgatgaacatgttggagccataattaaaaacacaataccagctgggtgcggtggctcacgcctgtaatcccagcactttgggaggccgaggtgggcagatcgtgaggtcaagagatcgagaccatcctgcccaacatggtgaaactctctctctactaaaaatacaaaaattagccgggtgtggtgctgtgtgcctgtagtcccagcaactccagaggctgaggcaggagaattgcttgaacccgggagagagagattgtagtgagccgagattgcgtcactgcattccagcctggcgacagagcaagattctgtctcaaaaacacataaacaaacaaaagaaccccaacacaataccacttacaataactcctcagtaatgacatgcttaagtataaatctaacaaaacatgacaagacttgtatactgaaaattgctaaatgctgatgaaagaagtccgagatctgaataaagagagaaaaacataccatactcaaggagtggaagactcaatatagtaaaaatataatttctcccccaatttaatgcagttcctgtcaaaatttcagcaacattatttgtgaatatatgcaagcttattctaaagtttatatgaaaaggcaaatgaactacaatagctaaaacaaattcgaaagggaagaataaagagaaaacagtctacctgatttcaagacttattataaatctttattaaccaagactggtattagtgaagggatgaatattatagatcaatggaacagaatgtagaacctagaaatagaccgaaacaaccatgtccctttgacaaagatgcaaaagcaattcaacaaacattgctggagcaattggacacccatagacaaacacgggaacttgacctaaacctctcaacttaaaaaatttaactcaaaacggatcagtggatcaaaatgtaaagctataaatcttttagaagaaacaaaaatacttgggatctaggaattcacaaaagaaaacagttgatacattggacttcattgaaattaaaaatttgctctgcaaaagactctgctatgaagatggaaagacaacctacaacctgggagaaaatatctgtaaatctcttatctgacaaaggacttgtatgtaaaatatgcaaaaatatttcaaaacccaacagtaaaaaaaccagaagaaacagataaaaaacacaatccaattagaaaatcagcaagagaaatgaacattttacaagaggatatatggatggcgaataagcacgtgaaaaggtattgaatattattagctattagagagatacaaatgaaaaccacaatcatatatcactatacacctatgttcttaaacaactagtttcctaaaaatactaagcatgtatttaacatatgaccaagcagtcacactcattggcattcatttcataattggcattcatttcataaagatgaaaacttacattcacacaaatcctatagatgaatgttcatagcagattatttttaatagcctcaaactggaaacagcccaaatcgccagcactgggttgttaaacaaactgtggtaatctatcccatgaatatgactaagcaataaaaagaacaactattgatacatgcaacaactaggatgaatctcaaggacattatgatgagtggaaaaaaacctatttcaaaaggatacatgatatgattcttttatataacattccttaaatgaagaaattatagaggtggagaatttgtgattcgctagggtttgctgacgaggtgttagggtaaggatgggtttatggaggagtagcacaagggagatctttgcggtgatggaatggttgtgcatctcgattttagtggtgatcttatgcagctacacatggaataaaattgtatggaactcatgcacacacacacacacacacacacacacacacacacacacacaccaaaatgtatgcatgtcaaactggtgaagtctgaataaggcgtgtgtattatataaatgtcaattttaaaatgttgatgttgtattgtagttatgtaagatgttatcagaggggaagctggttaaaggcactcagaacctctctgtaatatttttgaattgttttgggactctataattatttgaaaataaaaaaatgtaaaaagatgcaggtgtgataatttaaatagttatttaacctaatatacccaaaacattattattttagtatacaatcaatatgaacgctgttatttgtgaggttttttttggtattaagtattcaaaatttgatgtgtattttagacataaaatctgatgtgtattttacacatgtagccacatttcaggtgcttactggccacatgtagctagtcgatattgtattggatagctcaggtctagagagactaaaagcggtttgctcaaagtctcacaactaacttagcattcactcatcactcatgcatgcaaccccttaatcaattaaaaaatgggtctattttttctatgaggaatgtatgaataattaaaatgtgtttttcacagaccaaagacagacatataatcaaacgattaaaattcagccgaaagtgcaaacattgagatatgtacaaaagtaagtggctgaacaaaacagaaaggtatcatctctgagtatacaggtcaacagtgactcaggaataaactggattatttataaatttatccacttagatatgcttgccaccagaaaatttaaatcatagttttcaaaagtcactaattttgtgtgcttaaatgacatagtcattttgagaatcctcaactctaaaaaagaattctctgcaagcatcgctgaagaaaaaggctactctataaccccatgtacattacttcccacctcaacccccagacagcttctctcagactattctccaaagccaaatgttttcatagggataaatatctatgatccatgtataaacaatttatgcttattcccatgataaattttgaagtcaaatgcagctgtatgtcaggagtatctgcctcagaaggtacattttaacagggtatttttgaatgctttttaaaaaatttgttgtaagagtaatccagtgtgctactttcaagaaataagaattggaaattgtgaagactttcagatgttccatttgtaatgcaaggagaaaatagttctgctttacattcaaatttagcagactactagtagagtgaagtagaatacatttaggaagcaatcattgctatttatttaacagtatacatactgagataaagcaagagaagagtgatttactccattataggcaaactaaagagatagtgacctgcactgcattttcattgcattctttcaacagacatgtatttagtccagcactagtcaggagaggctaggttatgatgtggtaacagagtctctaaactgaagtggcttaacacacattttttttgttttactcatagtacatgtctactgtggtatggcatggtactatgctgattgtggtccttcactgactcagtttcatcttaattatgctttcatgatcactatagtaagaaaacacagctcggcaaatagcacattggcttttaaagggtcctcattttaatgatatgtcatttctgttcatatttcattagccaaaatggccacacagccatccctaactttaaagggctgggcaaatgcaagctaactgtctgcctgaaaggaaaaggaaactggaatatttttaaagagcgttgatagtttctgcaagcccctactatgtgccagaagtaaatctcgcaacatcctagtttaggagaattgtaccagtcttgtgggaaaatgcccacgtaggggaatgacatattatgctatgatatgtgaagtgctttctgagagagatgaacaaaagaatgccgtgggaataccaagaacagagtatctaacttcgccgaggaagccaagaaaggtgtatctcaagtatattccttgaggtatatccaagcatgaacattagagatggtgggtttacctagtgaacagaaatactatgagtacgtatatatatggagggagaggcatgggggctatggttggagaaaaggcaggcagggagggatcattctagacagcggaaagagtgaaaagactcttgaaggaggggcttaaggtccattgggtgcaggcgggcagggggaaaggcagggagtaatggtaaagagaagggtcgggccagattacaaaagatgaatgccataatgaagtgtttagatattttcctaagggcaagaaggaatcaatataattttggcagtcaatcagtatttaccaacacacctgtggcagattcagactgcctgaactttgcaaaagcaggatgaggtgtatgcttgaaaggacgctctcaggaaacagaaaagataacccacagaatgagagaaaatatttgcaaataatttatctgatgaggtacttgtatccagaatgtataaagaacttttaccactcaataataaagacaaataactcagttaaaaatgggcagaagatctgactagacatttcttcaaagaaagtgtaccaatggccaagaacacatgaaaagatgttcaaaatcattggtcattagggtaatggaaatcaaacccacaatgagatactgctttacaccaactaggatggctataatcaaaaagacaacaagaagttttgggcagggatgtgaaggagaaatttgaaccttcatacattgctggtaggaatgtaaaatagtgtggtaactttggaaaatatattggcagtttttcaaaatgttgaacataaagttaccatatgccccagcaatgccactcttgggtatctgtggaagggatatgaaaacatattcatgcaacaacttgtgcatggatgtaaatagcatcattattcatagtagccgaaaagtaaatagaatccaaatgttcgccaactgatgaatgcataaagaaaatgtggcatggatggagctggaggcccttattcttagcaaactaatgcaggagcagaaaaccaaataccacatgttctcactcataagtgggagctaaatgatgagaacacatggacatatagaggggaacagcactccctggggcctattggagggtggaggttgcgaggagggagaagagcaggaaaaataactaatgggtactaagcttaatacctgggtgatgaaataatctatacaaaaaaaatcccatgacacaaatttacctgtacaacaaacctgcgcatgtacccctgaacttaaaggttaaaaaaaaaaaaaagaaaatatggcgtgttcacacaatggaataatattcagcaataaaaagaatgaggtattgataaatgctttagcatagatgacccttgcaaacattatattatgtgaaagaagccagtaacaaaagaccacatattttattattccatttatatgaaattttaataaaggtcaactatatatagaaagtagattagtggtttcctagtgctgggggatcgggacaggaggtgaggtgagcttggaagtgaggtgggaggaataatgggtagtgacttctttttgggtgattaaatgttctaaaattagattgtggtgatccttgcaatactctgaaaatgtactaaaaaccattgaatagtacacttaaatgggtgacttgcaaggtgaattgtatctcaataaattgttaaagtaaataatatatggaactgtaagaatcttagatttccaagcactttgccttccacaggggcttcagaactgcttctagttgatgaaactattcaaattgaggatttggggcaaaggcttatgctcaattcttttcgatgcacattactacagagggagatagcaggtgactgaagtctttagtaagaatcatttgaggggaagagaaacacaaaatgacagtggtaactgccaaagcttctctttgggagtttattgatattcctaaatgataggagaagaaaactgatggaagaaaatgcaacagcctttaaggggcattaatttggcatcttgtttctcagctagtctcattacagcacttgacaggaaaatagatgcatttgatggcatttactcttttcaacatagccattacttcagaaatattatcacttttgatttttcaatttttgctgaaatggtgtttgatatagttttgttctcattatggagtctctgtctcaatttgctgaaaaagattgcaaccccagtgaagtatggcagaaaattaattaatgtgtgtggctatttaaagatcattcagcgagaacattaagtggtattttctagactatctgactttgatctgaacattctcttcatagagtgacacagatttcatgactggcaaacactgattaaaacatagatggttttattattagtattagtattatggtaagaaaacttactatgcaatctactctcaataaattgttacgtttacaatacatttcaacatattatatgttgactgtgggtacaatgtgatataacagatctctgaagcttattcatcttgcttgactgaaactttatgcttgttaattactcttacatattctcatccctcccagcccctggaaaccttcatttcactctttgattctatgagtttgacttttttagatatctcatatgagtagaatcatgcagtatttgtcttactgtgactggctgatttcacttagcataatgtcctcaaggtttatccatgtagcatattgcagaattttcttcttttgaaaagctaaattgtattctattctgtatatgtatataccacattttctttatccattcatctaccagtggacattttggatgtttccacagtgctgcagtgaacataggaatgctaatatccccttgagagtcagatttcagttattttcgtaaatagaagtgggattgctggatcatatggtagttctatttgtaattttttgagaaacccatactgtattccataatggctacattattttgcattccaatcaacagggtgtaaggattccaacttctctatatcctcctcaacacttgtcttttgttttttttgataatagtcaatagtcaatgactattgacagtctattagtctattgacagtagactaatgacaggtgtgaggtattgtctcattatggttttgatttgcatttccctgataattagtgacattgagctttttttttcatatacctgttggctgttgatatgccttctttgaaaaaatgtctgtttaggtcctcagctcattttttaattgggttagtagtttttttcttaaaaatattgagttgtaggagttatttgtgtatcttgaggtttcactgcttatcagatatatggttttatggtttgcaaatattttctccctttccataggttgccttttcattctgttgttacctttgctatgcagaagcactttagtttgatgtagtcccagataggtaggtaggtaggtaggtagatagatagatagatagatagatagatagatatagatagatagatagatagattacatatatgagtatccctacagtttcaggtattatgtttaagtctgccccattttgagttgatttttgtgtatggtgttagataagggtccaatttccttatttcacacgtggatatccagttttcccaacactgtttgttgaagagactatcctttttccattgtatgttcttggcacccttgtagaagatcagttgaccatatatgcatggatttatttagcagtatacaaaatcaacacacaaaaatgagttgcatgtctatgtactaacaataaacaatctgaaaaggaaattaggaaaacaatctcatttatgatagcaccaaaaagaataaaatacctaggaataaacttgattaaggaggtgaagacttgtatactgaaaatgagaaaacattgatgaaataaatgaaagaagacacaaatggaaggacatcctgtattcatggattggaggacttaatattattcaaatgtcaatacttcccagaaggatctacagattcaaataaattcttattaaaatcccagtggcattttttacagaaatattaaaaacaattctaaagtttttaatatggaaccgcaatagaccatgaatagccaaattgatcttgagaaagaagaataaaggtgaaaacatcacgcttcctgatttcaaagtacattacaaagctacaataatcataataatatagtattggcttaaaggtaggcatataggccaatggaacacaggcgacgtgccattcagagagccactgggattatgaaactctcagaaacaagtaattggtgaggtgtcagggtcccactcaagcaggctatggttcaagttgatattttgttgtcaataaaacattggaatatttggtagaaggaaacaggatagaaggttgttttatagactgcttcaacccaggctagggcttatgcgagtgagacagaacccatgtggtacacttggtgctgtgtctgtgagagcaagactgattctaactccattggaaggtgggccaagattgctaataaaattcatgccatcatcaagcctgatggaggaggctggtttttgtgagtccagataagagtggctggaaagacagaggctgacctcacttaaagatgaggctaacacttgtctttgttatgtaaccagacacatgcaataagatgcagcagagtgtagtgattatgagcagggggccatatgagatagactgaagttagattttcatctcctccattggtgtgacattgggtaagttgcttacctgctctgtgactaactgttctcttttgtaaaatgatgttaaaatgatatttatctctagggtggttgtcagtataaaaatgagacaattcacatcaagcgcacataataacatgtcaatgttagctattcttaatgctgctattattaaattagtccttccaactctgatccctgattctgtcattcaggctttgatttaggtagaaagatggaacatttttccaattaaatcagttcaacaaggcacagtatagatatgatgccttgttactcagtatagtctgcaaaccaacagcatcacctgggaacttgttaaaaatgaataatcttaggctccatcctagatgttctgaatcagaatctgcattttaataaggtccacagataattcatatgcacattaaggcttgagaagccctgtataatggattaccttaagatatgtatcctgctttcaccagttgttgcctgtattaccttgcgaaatttactaaacttctctgactatattttcccatctataaaaatcgagtaagtaagatgtgttatggttattacaaatatatataataacacttattaaagtgcttgccacaggagcaggtagtacaaactgcctgctaggaaatgatcatgatataattgtcaaagcttcagatgtggtcagctattgctaagccactcgctttgtatgtccctcaccatcatcctaaaacagatagcaatagtaggatatatatccaaaagtgataataaatatgggttcacaaactttttcttttcttttctttctgctgcttcttgttttttctttgagacagggtctcactctgttacataggctggagggcagtagtacctccatagctcactacagcctcaaactcctgggcttaagtgaccctcctgcttcagcctcccaagcatctaggactacaagtgtgcaccaccacgctcagctaattgtttttttttttttttttgtagaaatgaggtctcactatgttgcccaggctggtcttgaactctggggctcaagtgatcttcttgtcttggtctccgaaagcactgagattacagggtttacaggagtaaaacacacagcccagcccacaatttttttttctctgaagggcctgatagtgattatttttggctttgtgggccatacggcctctgtcacgactattcaactctgcccttttaatgggaatgtagccatagacaatatgtaagtgaatgagcctggctgtgttcaaaaataaaaatcaaaacaagtgtcatgatgcatcagattgcaaggaaatgaaggggaaattggaggcagatattggaattcattccttttccttcagatctttgggaacctgggagggaaacagagatgatcatatcattaactctctcttggagctgggaggtgtgggatggggacacatcttttgattgaggtgggttttgcttcttgtttaccatcaagtttgtacttgagaatgggtctactcctggtgtaatctctcctcattcaatgctcgcttatgcctagaaccttcctggcccaagtgtactctgttaaaaacttgctagagtcacatcatattcccaggaaaacaatctttacataacgtggattatacatggaagatttttgcatggccacacattgcagatcccagtggttccaaatatgagcctgtgttcaaagggaattgagtgaaggactgtattgctgtaaactgtgtggtcttagttggtagactcacttgaccaactctgtctttgagcagggaagaacagaggcttaagctgaaacctggagactctagaagcattgactgagctatatagtcagtgttttaggttgtagtaaatttatcttaagagttgggtgtgtcattgtcatccagatgatttaagcagtggctgagatcttggcagcaggaatttctgggttgcaagtttttccggggaagttgatccggtggaggcagagcctgaccaggtagaaacaccaggctctagcttttcaggaaaggaagctggcaggggctttttgtacaccaaacccaaaaatcagatggagtaaacccagtagtgaagcctaaacacaggaatagagaacgggcctgccagtacgagccagggtatagccgcatttccaggaggctcctagtacaaccatcaagcatattcttttttattgagatggggtttcactctttttgcccaggctggagtgcaatggcgcgatcttggctcaccgcaacctccgcctcctgggttcaagagattcttgtgcctcagcctcccaagtagctgggattacaggcttgcaccaccacacccagctaattttgtatttttagtagaggtggggtttctccatcttggtcaggctggtctccaactcccgagttcaggtgatccacccacctcagcctcccaaagtgctgggattaccgtcgtgagccactgcgcctggccaagcagattcttattaaagacaggttgtaaggcttctttgtccactgtgagccacagaagcgtcaagtagggactcactgtcatgaagtcccagatttgtatacatagttttgagtttttgtacatcactggatgctatatgttactgtacatattttaaatatcatgactttgtgtacttattcaaagattgctgaggatgttgcatttggacagggaaggggaaaattcacctgtgtgagtactcagtgggcttttatagcaatctgactgttcagagggtttccaaaaacctgttgcattggaaaggctgagtaacttgggattttgtatcactcaatttccagtgaggaggcagaaatctcttcagttattttaacaggaaaaatatgtacctcggtaaaaagaattgttaacaaggtatagcactgttaactaagaaactaaaaagactgaaagaacacactaaggaatcagggagggaaaaactacagaaagcaacttcacccctgaggcctaggaaaacaaaaagaagaggttggaattcttaatactcttgaaacttagatggtcagaggagtctccatggagttgaagcccagacctctgaggatggttggttctggagtttatgaataaagctgatcccacacggcttggaaaaactgtaaactgcattcagctgctgtcacgggagacactgccactgcagaagtgaagtgttggtggagaaatcctcagagggagcagacagaaagaagcaactcgctcttgcttcctccagctctgcagcccccttagagcctaatagggctccaactagaaaagcagaaatgtggattgaagaagccctgcctccacatcacgaaccagcgcatggaagagtgagttaggagctgaatgagaatgaattaataaatcgctcacagtacttgtgtatttttctgggacaagctttgggggtttgttgggcctgtctgtccattgagatgagaatttactcaggaaaacattcctgatttctccatcatcatcaccgtctcccaacacctacttcagcaatccataaagaatccatagtgggtgctcagttagtactgtgggttgagtgactaacaagatgaatgaagaactctcgtactctctgatcctggagattggaatgaatgcagtgacagaattttctgcctttatcttccagaaaaatagaattctggctactctagcccacacatgatccagtataaaatgactacatggcaacggcgtagccagagaaaatgtttctgtgacaagaaaatcagaggcaatgtcttctggtaggcagttcttttgaataacacccattctagaatgtgttctacctctttgagaattaagggaagtcggagtgacaactccatctcctacactgctgctcagagaggggaaccattctaagataactgtgaagttatttgcagcccatatttgcaaggaatacattggaagacagaaatcctactatattcaacacagcacagaacagaattggagctaattggtaatggcaagagctagaagatgttagacaattggtgacagtctgacacttttgtagagttggttaattacccctgttacaaagatgacaccactccaaattggcatgtaaagaacaaaggacaagaggagaagtagtgaattgtagactcaggtactacgagaggaaaacctggctaaggttttcaccttttctttttaaggaacaattagagttgatgccaggcttaccatgtgtatttataccctaatttctttaccagtcaatacatctagtttatccaccaaaaagtgggcctacaagttcataaaaagtactttcaagtatcaactgtaggttatgaatccagatttacttttttatcttgctaccttgtaatcatggctcgctcttttcttttcttttctttttcctctcctctccactcctcttttcttttctttttccttcccttccttcctgcctgcctgcctttctttctgcctttcttttctttctttcctttttgtgagacagggtctcgctctgtcacccaggctggagtgcagtggtgcgatctcagcccactgcagtctctgcttcctgggttcaaagattctcctgcctcagcctcccgagcagctgggattacaggttcatgcccccacaccccactaatctttgtattttcagtagagatggggtttcaccatgttgaccaggctggtcttgaactcctgagctcgagtgatcctccaccttggcctcacaaagtgctgggattataggcgtgagctgctgtgcctggcccatggttcttcttgatatgcactgacttcttccattctagttggcttcacatcatgatttttctgaccaccattattaatgaccacttctggctctattatctaactgatgattttcagaaagtagccctttctgatcgtatcctttgacctgtgacaagagggaaggcttatacacccatcccaggggatccctgccccaacagaagtcagaggtgtggcatcaggcatttcttttttttttttttttttttttcttttttttaaagcaaacctactctttttttttttcccccttccaactttgttttaggttcaggaggtacatgtctaggtttattacatgggtaaattgcatgtcctgggggtttggtgtacagattattttgtcacccaggtaacgaacatggtacccaataggtagttttttgatcctcaccctcctcccaccctcctccctcaagtaggttcctgtgtctattgttccattctttgtgttcatgtgtattcagtgtttcagctcctacttataaataagaatgtgtggtatttggttttctgttcttgtgttaattagcttaggatagcagcctccagctgcatccatgttgctgtaaaggacatgattttgttcttttttatagctgggtagtattccacggggtatatgtgccacattgtttttatccagtctactgttgatgggtatctagtaggattccatgtctttgctattgtgaatagtgcctgtgatgaacacgtgtgtgtgtgtgtgtgtgtgtgtgtgtgtgtgtgtgtgtgtgtgtgtgtgtgtctttatggcatcatgatttatattccttcgggtatatacccagtaatgggattgctgggtccagtggtagttctaagttctttgagaaatctccaaactgctttccacagtgactgaactaatttacattcctgacagcagtatataagtgttctctcttctccacaacctcgccagcatctgttattttttgactttttaataatagccattctgactggtgtgagatggtatctcactcattgtggttttgatttgcatttctctaatgattaatgatgttgagcattttttcatatgcttgttggccacatgcatgtattcttttgggaagtgtctgttcctgtcctttccccatttttaatgggattgtttgttttttgcttgttaattcatttgtgtgctttaaacattctggatattagacctttgttgggtgcatagtttgcaaatattttctcccattctgtaggttctctgtttactctgttggtagttacttttgctgtgcacaagctctttagttaaattaggtcccacttgtcaatttttgtttttgttgcaattgctttttgtgtcttaaatcatccctttgtaattacagtgtaagctcaaggaagagtagccccatgccttgttctggcaccaatggcaattgcagttaagattctaatgtcctgaatgattaaaacaagtaatagttgccccctacaaagcagtatataaattatgtagagtgtgttcaatattgatcctccactataacactacctcgtgatgtctgtggttgcaggcaaagttgggtgaagaacaaaagcctcaaattccttagatgttagtaaatttatattcatattgcgttgctgtgttccgctaaagcttgggcccatttcttcagaaccacatgagaagattctcactggaattgttaagagaacaaatgatgtcagaaatggaaaatgcaatttccaaggaaagtagcaacatacaggccagtgtaataattgtaagtttggcctgcaatgggaagtgtctctcctgaaatgaaaaacaaaaggttacacaccatcaattggttggctgggctgttaggactgcctgaaaagattaggaattactggttaaaatcatgcccatgggagaaaaatggaaagtacagaatgatatacagattagaggcaataaacacttttggtttgatgacatggtattgcaaagaaaatcttttagatagaaataaggggaataaggtgtccagaagaatataattttctttgcatatgtgcctgcctcttaacaatattagctgataggtagcggtgagaattaaggcagagaggatctctgaaacgtgctaagcgagcagagatttcctttaaaaacatcctgacaggctgcttgaagtctccaggtcaagactgctaaggattatgagatgatgtgaatccatgttggaaatacaagtgcgtatcattcaaggaacaggggaccaaattaggtttcctttctttatggagggacacagctaaaatcaaagagatattgtcatttttagccatactctaggacaggttaaatctcatttatttgttttatggaggggtagcgtgctttgccccatgaatttcaaggtgaattgttcatttcaatgacttattcactaaaaatcattatttatgttgactgtgtgcttacgcttgtgctagaggcaagtcatgctctttgttcaagagtaaccttccccatagaaaaagtgggactgtagctactttctacattttgtggttgatgagccatccatgaagctgagtacattgcccgtgacttttgcgaatcttggctcacaggttttcaactggataaaacagttgagggccatatgtgcctattactttgacttatgaattgagcacatgtggcttagaattgggtataagtttgctgatggaaagcttatcaagatagtgcatcacactgccaaagttggttagggatctgctgatatcatctcagtgcctactttgatcaattagtcttggctgccttcagggttgagttgaaaaagattaattatgaggactctgattgatcagtctctcatatgctggtgaggggaggcagcatgctaataccgtgcatttgccatccctgtcctaaagaaaagtatctaactgaatagtttgataaaagtccagctgttgaagggttgtattagattaacttgataagccttcttccaactacccttctgtgttgttctctggatattatgaggcatgaaggaaccatcaatattttgaacatgaaaatttacctactattcattgaacgattctatttagtgctgtaacagcccaataattgtaaccttgttgcaaaggagataataaaaagttaatgaccaaaatatttgaaaggaatcaggaaatgtgttgctcttggaataagtttgtacgtgacagtgaaaagtcaagccacaaaaatctctcatgagcatttactattttcaaagcttttcattgagacccacagttcattgaaaaaagaaaaactaaaagaacattacatgatgagatcggtctaatattctggtctgtataacagtgaaatatgtcaatggaaatgagaagagcatctaacaaaagggagagcagagctttttcctcctaggcttatctcagcaatgatctctcttggtggagtttcattaattggaatacatatcctgatgaaaattaggccaatatccagccttgtctttccttaagaagggagcgttcttttcttgttgaatgaaagacatcgattctgtttatgtctccttttccagtgtgtctgttgtgtgtcagaaaatcatccagcataagaaataggaagacattagaagtctttttaaaaaaaccctaatgcaaacaaaatttggcacaataaaccttattgttcctctgcatttattcactgagaagtaactcagatcctaaagtatcactggtaagtatctgtaaaaccaaaagtgctctggaaatgagacagtacagatttttctgctgaaattttcctgcaagaaagaagcaggccccaagagaagtgttttcctgaacttgaggacattttcctggtgaatgggattagatagtaaattatagcaaatgagtactaattccactttattggaaggaagcatagtaatagcctgcataattctaagctataaattattttggaaaaaaaaggcattttaaaaaacaacagttttgtcattttggggtactaaaactctccacatagtaaggggtttgggggcctgcttaattaatagctaccttgtatttacttcataacatttaaacacaggcaaccaacatgggctggatgagataattcagtattgtttgcttgtcctggtggcccttttggtcaggggcaagggtggaagtataaggatatgtttattacatgatgggttgttagtggacaaatcatccagtttctcactgctcagctggcataactctgaggtatgttctgcacagtctcctagaattctgtaaaggaattggactttatttgcccacagtggaaacttggttggtaatgctttattgtatgcttgtccttcactgcctcaattcctcattccattacagaggtttccttggatcacctcctacaggaaccactcatacttgcagctttgtcaaataatctgcttctcaggaaacccaaaccaagacacaattagataaaaaacaaattgcatgagactgagagggagaacggcaaatatagtttaggatgaaagacctggaggttttattttactgtagatgtaatgagtcaatgactgtgatgtgggagaggaaattatttctgtttcagattccaaaaatgaaaacaaacctagttgtccagatcaagggaagttttacagtcattatcattcaagctatgtgtgtaagaccagtcccttcactgtaagaaaaacattattgagtgagatttaaagataggggcatcatatcgttgagaaagcattacaggaactggtgacattcaggctataaaagaaaagaaaatgtaatggagacatcagagttgttctccaattgtaaaagaagtggaggtgggagtattttttttgtctttttattttttttttatttttgtgggtacgtagtaggcatatatttttatgtggcacataagatattttgatataggcatgtaatgtttaataatcatatcagggtaaatggggtatccatcacctcaagcatttatcctttgtgttacaaataatccaaatatattattttagttactttaaaatggacaattaaattattttttactatagtccccctgttgtgttagcaaatattagatcttattcatgcattctaaccatttttttttttgtatccattaaccattaccccaccccagccccacactgtccttcccagcctctggtaaccatctttctactctctatgtccatgaattcaattgttttaatttttagctcccacaaataaatgagaacatgcaaagtttgtctttctgtgcctgtcttatttcacttaatataatggcctccaattccatccatgtttttacaaatgacaggatctcattcttttttatgcctgaatagtactccattgtgtatacataccacattttctttatccattcatctgttgatggatacttagattgcttccagatcttagctattgtgagtagtgctgcaataaacacgagaatccagatatctctttgatatactgatttccttttttggggggtatatatctaggagtgggattgttgtgttgtatggtagctctatttttagtttttcaagaaacctccaaactgttctccatagtggctgtactaatttacacttgagttgggcttattttgaattattcagccaaagaaagactgattgggggatacagagaagggaatttagtgttcatggtataattggaatgagacaaacttgacttgaaatctcgtgtatggaatttactttgtaaactttctgagggttttctcatctggaaaaatggaataatatcactagctctgggatcagacatgtagagaacctcatcccctttcccaaattctgtaacagctgaaggtaataaacaatggcattgggagctttgcagagggaaaaccatgacaatcaagtgtttaaataactaaatcagtagtgtatattgcttattggattcctttgatcaagaatatccagttctagctcaagattcttttactgtaagaatttgggtatactgaaagcacctatatattcagattaggaaaggtgatcattttgtggcatcttcattccctgtctgacgaggaagatgctgctccacctttcttttagagttaaggctctccatggaatcaccccaacccctacacccttgccagataattttagcttagactctggagaacagtggaaactattttgagcatcactcctcctccagtttctcccatatcaggtaagagcaacccccactcactgttccctccactcagaggctcttcttgcagatacctccatgaatgaagtggagccaacagggagtataaatgctccaaggcaacaatatgcattgctggttagaagagaaggccagtgtgactggagtgaagtgaactacaggaagagaggtgggagatggagaggacaggtagctagaagccagtgcaaatgtcaggtccacagagaggccttcccaactgctgtctgaaacagtgccctcaacctctgtcacttgctgacacccttaccccatttttctttctttctcaagacttatcaccgtctagcatattatatatttattttattatttgcttagatgtttcttcatatctgaatgcaaactccatgagagtagatactttgactctttttatcatttatttataccctgaacctagaacagtggcaggccacagtaagcaattaataaatatttgtaaagcatgaaatgcatgttgagcctgaaggcctatcagggtcttgagaaagtaagcagttgctgcatgacaaacctactccaaagattagtaacctaaaactaccaccatcttccaggaaattcatctggtctgggtctcactcagcacctttcttgggccttaggcatatgtcttccttgtctggtagtttgcgagcagtttggtgaggtggggacaaaggggaagtatattagtccattttcatgctgctgataaagacatacccaagactgggcgatttacaaaagaaagacatttaactttcttaagaaagttaagtttcttaaaagtttcttaagaaagaggttggacttttattagtttcatgtggctggggaagcctcacaatcatggtggaaggcaaggaggagcaagtcatgtcttacatgagtggcagcaggcaaagagagagcttgtacagggagactcccatttttcaaaaccatcagatctcatgagacttattcactgtcacgagaacagcacaggaaagacctgccccgatgattcagttacctcccaccaggtccctcccacaacacgtgggaattcaagatgagatttgggtggggacacagccaaaccgtatcaggaaggaacctgggttctgcattgttcatcagcctgcaggattctgcttgtgttaagtaaacttctattcctttagccaagtcaggagaaccaacccagattctagtggtggaaactgggtggggcccactcactgatgggtggagttacaaaggcacattgatcatgagggtttggtgatggggaaaggaagattcgtggctatttttgcagtttaccacaagctctttgttctttgtctagttggctggtctctatcttgttgagctacatgcctatttttagagcagtcagggaactatcttgtttatctgaacattatctggtgcaaactttctattctagtctttgcaagttcatgtcttttcatgaaattgctgggaatccccagttgttctgatattgttttatcttgcctttttttgtagattaatttggaagaatgtaagctatttaaaatccagataactgtcattttgtggtgattctggcatgtggctttcttcataattttcatggttgggaggagctaatgttatttctgtctactgcagaagcattttatcattgtggcatttctaagccaccatctgatgtccatgatctacagttgagtcgttctgtttttcttttcagtaggtttttcccttgccgtttggaggatctttttcatttcgctgttggcctacctttttgtctgtggcctaatgttttgtctatgtgtctataagtgtggcacagtgtcttgtgccacatttatagaagcaattttgctcacatagctatatgaaaacatacgtgctagtacatactaaaacatacacggaagcaaatgtatgctgtagcacgtcgcttgtgtccttcaccattttcatccaacttgcctgtacctaaatgtattgttctgaggcttctctctggcctccagggtcttatttgcctacctgcagcaagtcataaacagtgccacggaattacccatttcccaccccatccctcaaccaattactaaagagagttgggggtacaaatcccgacctccttcgcctttgggttagaagtgataattttgagatgtgctcagattttctcagagggctcaagctccaatttcttaccaggtaaacctgctcatcactcgtgtactctttattgcctgtcttcccttcccctgtcatttgcatttccttcccaaataaactacccgctcagctggcaattccttgtctcaggttctgcctctaggggaccccaaactaagatatatgcacatatctttctcattggcacagtaacatttcctcaaacctaaacactgttttactaactattacattacattttgtttctgttgctcctgggaatccaaatcttagaaaggtcagattctgtcagataaattgtggcttttctaacaattcttgcccctgcctctaagtctgtgtgtgtggtgggggggaaggagaggaaggtaggtaggaatgtaggtgagcttgtgtgtgtatgtgctgtttgtgtgtgttttcaagggggtgggaatgggtgaatatctatgtgtgtgtttacatgtatcatgtgtcaataatgcagtgaggggaaaaagatgtggaagtatatttttaaaaataatttaaaaaattaaaatgttatatattgtgttcactgttgctgttaacaatttcaagagtggaagggtgatgttagcactgcatttaatgactgtaacgtgcttggtgttaagggcaattagtagtgaaaagggaagtacaatagcaagatatcttgtttgtattactaaattataaattgaagcatctgtaagaatgaggttgaggctctacccaataatctcactgagtgttgtcagtgcagctaggtaaggagaaaaaatagctttgttcttgctgcccgatatggtttggctctgtccccacccaaatctcatcttgaattgtagctcccataattcccacgtgtcatgggagggacctggtgggaggtaactgaatcatgggggtgggtcttttccatcctgctctcatggtagtgaataagtctcatgagatatgatggtttttataaatggaagttcccctgcacaccgtttcttgcctgctgccatgtaagacaagcctttgctcctcatttgccttctgccgtgatggtgaggcctccccagccatgtggaactgtgagtccattaaacctctttcctttataaattacccagttttgtgtatgtctttattagcagcgtgagaacagactaacacactacacttctgtgggaaggtaggattatgccctaaaatctgctcagacagctgttcgtagagcatgtgtgtgtgtgtgtgtgtgtgtgtgtgtgtgatgggggatgtgagtggatgtgcgtgcatatgtatgtagcaaggggtggtatgtatctaccaaaaagcgaagtcatctttctctcatgctcaaatgctttctcaggccccaaatctaatgatggcttactttgtgtgttgctgttttcccctagtgtcctggaaaggatgagttactttcattttcttagatacgcctaccgaggactagaagacatgtggaacatggaagtattagcagaatatgatcatacagagttgttgcatatactaggatatcatcaccccggaatgaataatcagtagtaattatataaattatcttttcaagaatcagttgtatttagagctttaagtaccaataataagattttagtaaacatatactacctgtttttttttccagtagaaataatggttccaatttaagaatattgcaaatatcagtggaagagaagcctcaaattaattcttgtctgatgattttgttcactgtcctgggaagtacacaagctcttcactcaactgttagatggagtttccatttatacatcattctttttaatgaacaatggtgctaaatctgatttgttagtgaaatatagagatgggaaactaagatgggtcaactgagatggaggaggttgtatagcagtgggtaattccaagaacagcaaatcctgccaaggccttaccatcaggcctcaaagccatgcacccagctggtccatagaggactgtcttgggtgtatagtgttgtggctcagtagctaaaatttcaaaataataacatggtgttattgtcaaagtaataacttgtcatcagctgccaaaacttcctagatgctaccaaatctccatcacttcaactagaaggtggttgaaggggaggaagtggcagaaatgattccagcatgaattgtgaccttggcacttgttcttgccaatgagttatgctgcctgtacatatgttgtggcttaaattcaaaacatttccagggtcaatattggatgttgggttaaaattactaatattatattatcagaaaattgaaaactcagcacctctggttattatttcaaatatgtgggtgacagcctgcagtcaagtttatgagactatgtttcgactttcttcttctagagatttagctctttattgagatgcaactgcagcagctatgtgcttttcccttactatacttaaatgcattaatttctcatgtattagtaggcccttatattttaatttcctgacagcacttccaatctagttgggaagacattatctggaaactaagcccaatatcatatatgagtggagctcttctgtgagtttttttggggatttcaggagtacatagacttctggaaggaagcagaaagcaggggccctgtgggagggaccctgactgttagatgggggcacaggaacagggacacagacaatgtttggtactcagagtcatccaagtatgggacaagatgattaatcagaacaggatccaggaagcttgcaagagattgtgggagatagacggtgagacacatggcaagaggatctatctgccttggtaagaaggatgtactcatatgtctggaaatagttaaagtgctggtcatgtgggctgagatttagggaaatgtgcaatgccaatatgatactaaggcaaaaactcaatcctacaatataaacagcaagtgtgaaggcaagatatggggtacccagggctcacctcatgcatgcctgctatggagtctacaacaggactaacttcaggtccaaatgttgagactgatgtctttgtcacagttgaagtctatttggacctggtagggaaagtggtttccaagagaaaaatattaaggatgaccggggaaagcaagggcttaatttctgtccaagttttagggtcattcctatacttcaattgattttgctgtggtctaactatacataagctctttttttgtttgtttttttttgttttttgttttttgtttttggacactgagacttgtcttttcctactcctcagctggatttccagtttccaaacccttggcttgatttggcaacagtgggtactccaattcctaattttccactttgtattcagtttgtattcagattttgtgtctattacactgtgagctccttgagggcaggaaaacatcttcctgatctttgaatcttgagcctatacacagtgccaggaatgatagattttcagcaaataaaggaatatctaaatcttctcacagggcctggtccaataaatcttaaccctgtttttccttatgtcttaatatggctctctgtatggttatagatatgaaaagacatcatgctaaagctttgttataaccagataggaatccagagttaacataaagcacaaacaacaaagtcttatgcatcagaatttggcaagtttctgaaataaggtgccagtagcctttttgatttattcagtagtgactaattttagcttattaggaaggggaaataaattcaactttttttgacacactcatctgacagtccctaaatctcttatgtcctaagtgtttttttttctattatctaactgcctaagtaggcaaaagccaacataagtcagtcccatcaccgtctgtgctctagagacctccttagttctcactcttattttctcctggatgtgtcaagttcttactaaaaaagagatcacaaagtgtctagaatgccttttgaaaactcagggaataaaaaaaatggtcttatttgttaaaacatacaaattatccacccaatagtagcattaaaaaagaaatagtctcaatattaatgttgttggtgccacatcatgtccccccagcactctctgtgacaggagactcacacaaacagttgtgtctctttgcctgaagactttctgtggttacaggagcaggccaatagtgctagggagttagatgctcctgggagcagtgcttcaccaatgatggatgtggaggtgatcattaaatatctgaggtattgcctagaggtccccagcagttccatgttgagccagttgctcacagtacacactgtagttgcttctttcccttccctgccttattccaccactcgtctcccaaatacactattagtattcaaagctttggctgtgtgtctgcttttgagaacccaaacaaagacgttggttggaaacagacatggacggtcaatgtaatttcctactggatattaagatgagcccatgtaggtaaaaccagtatacctaggtcttagtattcatgtgaacccatttgtgtagcagctggctgataaactggggcagtgtagagagagtcagtggggtccccaacactggttcacatttctaccatttaaatgaacgtccttttctctggttatgtctcttataaaatgatgttcacggtagatggaattttcttttttttgccttttttaaaataaaattactcagcaaaatgataggttggcaagtatactcagcaatcagcggttttgtgtttataattgtacctgtctgtaaaaatcccaaagtcctaaacacatagttgtcatggaagatgcaagggtatggaaaatatatggacatagaaaatgtatagtaccatatcggcattgcacattttcctatacaggacatagaaatcccgatctgtattccaaatctcagcatcatgcaatatttccatgtaataaatctgcacatgtacctccatatttaaaagctgaaattttaaaaaagatatctgaagtgaagaaataaaggaaatgcacctgcaattttgtaggtgagcaggtaacagtgctgtctacatatttgggaggaaatccattaaactctctggtcctctgtatccttttgagtgaaacaggaggccgtcagtgatctctgaggcttcttctaaggtctagcaatcttgaactgctctggctgtagggcctctcagactgtaaaaatgaacatgttctctttggtggcctctcatctctttttttttttttttttttttccacatctttctgcttccccaaagcctgccttaaagcctgttatgctgtttttcctaataaacatgcattctgaggacatgaagcatctcttaatcatcctttaatctgtggtatggggggtatttatttaaaatattatggaataagtggcttctttagatcatgtgtgagtcattttgtagagactggctgagttggctaagaactgggggtgacatagggcccgaggagagctggtgctcagaagttgcctccagaagaaaagaaaactcgaggcagagaaaatttgagcagaagcctatttggtctaggagataagaagtagacagactatgtgaattcaggaaaggcagcaaactaggggtgttataaagcctgaccactcctccccacgtagtaagctgagcctcagaaatctaaagtgttcccatcacccaggcagttagcgtaatacccgatccgtattccaaatctccgcatcatgcgatattcccatgtaacaaatctgcacatgtacctccatacttaaaagttgaaatctaaaaaaaagatatctgaagtgaagaaataaaggaaatgtatctgcagttttataggagtgcaggtaacagtgccctgggtttctaccagagtgctaaaccattgcttccaacgtgggaggaggaaaatgccagcggtgacttgcttgctctttagaatgaaagggaaagggatgtgcagatggagactggcctcaggccctacagaggggagaaaagagagagcacgtgtcaatattagcagagaggaggcacaagatgttgctctgtcgcccaggctggagtgcagtggctcgatctcggctcactgcaagctctgcctccctggttcatgccattctcctgcctcagcctcccgagtagctgggactgcaggcacccgccactatgcccggctaattttttttttttttttttttgtatttttagtagagacggggtttcaccgtgttagccaggatggtcttgatctcctgacctcgtgatccacccaccttggcctcccaaagtgctgggattacaggcgtgagccaccgcgcccagccttttgttggtgtttctatgagtccttcgaatttttgtgctttctaaattgtttcactagttttaaaagtaatacatattaattattacaaatttggaaactatgaagaagcaagaacaagtgaataagtcaccaataatttctatactttttaaattaatcatttttactacttcctccctttgatacttgcatatgctttttgttggttttaaagctgtggtgtgtgtctatgtgtgtgtatgtgtatatagttacagttttttaccctggtttgttttagttagttttatgttgtgaatattttccttaattattagttttccaaagcataatttttaaaatgataaaatatttcacttagccacttcttgttatgcgtctggcactttgctagatactgaagttacagatataagtaggacaggacgaattccagctttcttgacaattaagactttagagcacaatctcatgaacattattggaattagagtttgttcccagtaatgtctcattgagaatggcctcaggcttgaggtaagcggtgtgtgtgtgtgtgtgtgtgtgtgtgtgtgtgtgtgtgttttgtataaacattagcggtacagagagttacattagagatgttctcagttttgtcctggcctgtccttcttaaactcctgtgtaaactggaataacccaaagacaggccacatgaactttctgatgacaactaggcagaaaaaatctcagtataaaggaataactgatttcttctctaaacaaatcttaaaactgtgatgggaatagagtacctccttgcaggattattgctagcctaaaagaaaggaccctttgactcaaggcttcctcagttcataaggtagcatataggttcggggcagggagggagtccttacatgggtccttcctatcattgtgtcagagggatctactcgtgggctctatgttcgtgtagatatatcatcgtaaatggaatgtcttgctatttcaggcatatccatttctatcacatcaaaagtagcatatctactaactctgtatattttgggattttaaaattgattggattgattgcattttttctaaagtagcaagagccttctcagataagtccaaagtgcacaaaccataggtatacagatgaattttcacaaattgaacataccatgtaaccagcacctaggtcagtaaacagggagcattatcagcacccagaagcccccattgtgcccccttgcagccactgttcccctcatccaggtaactaacccctttaagcagcctggataacttttatctttttaaaactttgtagagtttgctctctttgtgtttggcttgttttccttaatattatacttatgagattcaaacatattgttgagtgcaatgttgttgttgtttttcttaaaattctcattgctgtgtatatttcattgtaataaatataccacaatttatttttcattctactgttgatgaatattgaggtttgttctagttttgagtttttaagaatattgctgcaataaaaatgcctatagaagtctttcgatatgtaatatgcatacatttctgttgaggacataaagcagaattattaaatcatagggaatacatatattaagctttgatagatgttgaccagctgtttttcaaagtggttttaccgacttacactcttaccagcagtgcatgagggttctagttattcatgcccttgtcaacatttggtatgtagatatatttatgtagtttttgccttttaaccacagtatttacaagacataaccaagattcaaaattttgggcagtatgttcagagagcctttaatcatctttgtatcagtaatgtttaatcagaagatataaaaccagatgcttagcaatattccattcttattaagaatgcaaagatgttatttcagaagacaatagtgtttatattagtttgtcttttttccttttctctgaacagaactcagacacaaatattagtttttctctaacattcacttgacaaatagctaatagtagcaaataaacagctgcagtcccttttcactctggcaaaatggtttacctgagctccgctaggaaagcacagtgacattccattaaccataatttagctacacaaccatagacaattgagaaatgaactttaacaaataaagttttattggaacacagccacatccatttgtttacatattgtccgagacaaagtttagtagttgcagcagagaatacgtggcctgcaaagcctcaaatatttactatctggctctttatagaaaatgtttgatgacccctcccctagcagtatctattttaattactagcaaaatctgagaagcggggttaacatgccgtttagtgaaaattccaaagtctcagtcctcataggtcttcaattaaaatagatacctctatgggtagggttcatcaattgttttctgcaaatacttgaggagataaagctttatttgcggatactggatttgaacttcatatatttttcatgttttatgaattattactcttctcttgatttttccccagccatttaacaatgtaaaatccattcttagttcatgagaggtacaaaaacagacgttgtgctaaaatgtgcctgcatgccatagcttacttatcccttctctagggtattaattgctgacaagccctatgaagtcagagaccttgtctgctttgtttcattgctggagctccaaccctggtatcacacctcacgcagagtctatgctccaaaatatttgtggaatgaaatactactgccatgttaaattatgcagcatggcacaaatcctatgttgaaattgagcgggctttatttattctactctgcatatatgtatcatatgcctactatgtgttctcctttgtgcgaaaaaagatattatttacaggacctgatgccagctacttggaagaaaaactcattaatgtgtcattcatcttatactgcaactgtcctacattcaggacactggatattagtatagtaaattcatgtgtctatgaatagccacagttattatctgtcaggcattttgatgagaaaatcaggagcataacttaacaatgaagtgggagatattttttccctgttcccatgggcaaacaagagaacagctaacatttctttagataatgtctaataaattatgcataagttcaaatttataaacaagtcaaatctcagcctgcaacatgggttgatatagtacaagctggtaacacttgagttttcttttattgtactcattattaaaataactagtcatcatataaaatttttagacatttacagaagaataaggaagaaaataaatacctagtgaaattatcaccaaggttaccagagttgacattttgttgcatcttccctcactttatcatctgtctcttcagtcaggacatgagaaaactacaaacttcgagttaaacctactggtattcatggtggctcatgcctgtaatcccagcactttgggaggctgaggtgggtggatcacccgaggtccgaagttcaagaccagcctggccaacatggtgaaaccctgtctctacaaaaaaaaaaaaaaaaccaaaaaactaaaaacaaaaaacacaaacattagctgagcattgtggtgtgcacctgtaatcccagctacttaggaggccgaggcaggagaatcacttgaacccaggaggtggaggttgcagtgagccaagattgcaccactgcactccagcctgggcaacagagcgaggatctgtctcaaaacaaacaaacaaacaaacaaaaaactactggtattatatcctctttttgttattggataactgtgtgactttgggcaattacttaatatctccatgtcacagttttcttacctgtaaaaataggataataacagtatgtaccaatagggtattataaagattaaatgtgataatactgcaaattacttaccgtaagtgcacgataaaggttggttgttattaatatttaaatttataaaacaggcatcacactaatttggtattttttgtctcctcctccccttccctattttccccctccctttccctatttcagttcttccccttcccctccctctccctgatctacaatggcatcacaatgttcccttttatgggtatgctctcatttactgtagaacagttaggattatttttcacctttcactactctagttttgtagtaaataccctcgtatatccatgtatgttaatttctcattgaatctcccattatttccacagtatatttttgtaaaacgtaattcccgggttaaaatgtaagcctatttttaaacttaaaaaaaattaaaatttgcctttaaaaaagcttataccatataatagtcataaaagcagtctgtgagaccggcagttttactgccatgtatcttttactactggccgttacctgattcatgccagataacactgagtttgtactagggactaccatttcttggctaatggctgttcttcatccttacttagtaataaaatctccagtttttagctaaggatgtaggcgcagggaacaaacacagcatttctcatattcccgtgcagttgagtgtggtcatatgatgccggaaaatatgacatttgcaaattctagcgagaatggggagaattatagggagaaaggagaatattcccctttcaaggagggaaatgagatcttttgcccattcctcattcttactggctaaaatgaaagcataatggctgcagctctaactgttgtgcaccatggtgtgaccttgggaaaggtcaatagtggagcagaaaaatagaagcagcctgcattcctgacgctgaaaagcccccaaagcaactcagggcttctatctttttattatttgtgagactttggctacttcttgattctgattaagagttttcttaataacttgcaaaaactctttataaattaagaaaatccatttctgacaaatatttcaaatatttctcaggctgatttttcatttcatccatggtctttgttagatatagatgtttattattttcatatatatttagaataatgtctacagtacttcttctgtgctaagcatttttctaaacactttaaaatattaactcaatcttcacgacaaatctataaaatggaaactcattaaatcccaacgagaaggaaatttaggcatagagaattaatttacttaaggccacacatctagcatgtggccgagctgggatatgggaggtctgatctggaacccatgtccttacccaccgtgctatctacttcagttgtatctcctccaagtcagtctgcatttgtgagtactgtgatcgtttggggcttgcgagccgtctagattttaaaataaatatgtattttttaacttttttgttgatcgtttttgctttctttttatatttaacactttatgtataatttcttttgatggatggtataagataaagttcttatttgaaattttaaaaatatgaaaactttccactcacttttgagcatatatccctttttcactgcttgttaaaatttccttttttttaaaaaaaaagaaactacattctcatacattctaggttacatttcaagactacttagtcatatctatctatctatctatctatctatctatctatctatctatctatattttgagacagagtctcactctgttgcccaggctggggtacattggtcccatctcagctcactgcaacctctgcctcccgggttcaagtgattctcctgcctcagcctcccaagtagctgggacgacaggtgtgtgctaccactcccagctaatttttgtatttttaggatagatgggatttcaccatgttgacctggctgctcttgaactcctgacctcagtccacctgccttgacctctcaaaactctgggattacaggcatgagccactgtgccctgccttgatctatatattgtttcatgctgtatttgttaaacaaatgtctacataatgcctattatgagctggacatgccatttaaattgttgcagttttataatatgttagtcagttgaaggattaggaggttcataaatttggaaaggagagctttatttcttataaagagttgtagcctacagggtggccattttgacaggctgggaagccagaaacaggcagttcaagagaggggggaaaagggaacagaaatttatgctgagtaggttagctaagtatacacattcaacaggttataggaggagctatgaatattcacgaaggggaggcacaggcatgcatagtaggccaacatgtatgcaacatgagttctgatgttcactttggggtagagacttaacatttaaatgtattacaattagaccctgtacctcaacaggtgaagcagtggacacaaagtccctctgtgtgcagcctctatggattggctagaaccaccccatggacagtggtctcttaccaggaaggaatgctggtcagttgctctgtcaaaactgcaaaaagagagggacagcagtcagtgagatggttgaaaacggtggtggagcaagtcttttgaaagggctagtttctatttagcacttagggaagaaagcctaatggcagttaaggagtaatgaggtataatgaggcatgcccgacctcccatgccatcatggccaagaactcagttttaaaggtttctctgggatctccttggccaatagggtgtctgttcagtcagttgaggagcttagaattttatttttatttctcatgtttaacagagagcaagttctcagtctttgaaaaccattcttcttcttttttttttgaaacagagtctcactctgtcgcccaggctggagagcagtggcccgatctgggctcactgcaagctccgcctcctgggttcacgccattctctttcctcagcctccggagtagctgggactacaggcgcccgccaccatgcccggctaattttttgtatttttagtagagacggggtttcaccgtgttagccaggatggtctcgatctcctgacctcatgatccacccgcctcggcctcccaaagtgctgggattacaggcatgagccaccgctcccggccgaaaactattatccttttacaaaaaaagttaaaagaatattcttccatttgagatttgttctattaataatagaatctgttttgtgtattacttaagctcataaattaacttgaagtgattgacttattttaatgattcactctttacaggtggatcgtagtatgtatctccatttatgcaagtattttttcctggctctctagagtacatatactcaagattattatctgaggtatttgtacatattttgttgttattcattatcatatagctttttttttgataaatagaacactttatactttctatttttttttattttgtgagtttactaaatcttgattgattttaagaatttttcagtggattatcttgagttttataagaaaatttttggccgggcatggtggctcacgcctgtaatcccagcactttgggaggctgaggcgggtggatcacgaggtcaggagttcaagaccagcctgaccaacatggtgaaaccccgtctctactaaaaaaatactaaaattagccgggcgtggtggcatgtgcctgtaatatcccagctactcaggaggctgaggcaggagaatcgtttgaacttgggaggcagaggttgcagtgagccaagatcatgccactgtactccagcctgggcgacagagtgagactccgtctcaaaaaaaaaaaaaaaaagaaaatttttgtgtcctcttttctaaatgatattaatattgtttcttgttttattgcctcgcccaacagttccagatcactgaaaaagtaagaatatagttaaaagaggcatttttgttctacttaggaattaatgtttttgtgtatgtttattgataattgacatttttcatttcaaccaaagtgaagtcacagtcttctcatttatacttgacaaaaaatatcttagaaattgctactgaattttattaaatgcatctttgacacagatagtttatgcttctttgatttttgatatgatatatatttaatatttgtcttaagtcatatgcacattctaatgaaaactctactcgtcatgttgtggaaggttgaaatagttaatgaaattttttgctagtacttgatgtggaatttttgttctaattttcataaataggattgggttctacatttcctttttgtgccacctttgtcaggtatgacagttatttagcttcccaatatgaactaggtagttacctatttttttctgtcatttgaaacagtttatagatcttggggattatctgttttaaaaaagtattttaaagagttcaccagtgaaattggactggactctctttaaataaattaaaaaatgccatcagagtttatgaaaaaaattcttaaaagtaccaaagatgtgacaaatagtaagaaattgtcatgcatacatttagtgaagatgggaacacagagatgtaggtaaaatagtgaagccaatttttaattttatttttaaaattgacctatattttacaatttacactgtatacatttaaggtgcacaatttgatgatttgatatacatgtacaatgtgaaataatcaccacaagcacacgaattgacatatccatatgtctcctcagctctgagtctaactggagatcagaaaccacctttgcaatgagaggatcggctcattctggcacactggttttgagtttttaaggtgtcatatttgtggatggggacagaaaacaaaaacaggaagtaaaataggggaagcctctaagttcagacaccaaaatgttacaattaaaacatttcccaccaccccacatccatggggctgcaaggaacttcacctgctaccaggtgctattttaagtgcttttcatacattaacttatgtgattttcctagcagccctatgtgataaaaagctcctatactcccttgttacatccattcttaaacacttctttttatctaatttttacatctcaaagggatcgatcaatagcattttacacttttggttgttaatgggtttttttcctttctttgaggcacatatagtgttggcgggtggaattgaggcaataacactgttttgtcctcatttacagatgagaaacctgagatagagacatattagttggtagaatattagacctggtagttggtagaataagggtttgaacctaggaggtctggctccagagttttggttcactcccagagtcccatccatactgctgtaagctttccacaagctcctttactgtatcccttcctcttaggcttcttatgcttactggattgtggtgcatttggctgctctaagctttatgacttgcttagattaccacacctgcttggactttctgaacctcatatccttgatgcctgcctaccaccctggtctgctctgctgccccagcgtcttggaatccaaagtcaagcctcatgcctgtcatatgcccacctcttgcatctaattcctcatcagcttatctcttagcctcatcttggccttctgtgcctgatttctgtttcccctgtgtaattcactggttatctcaatgtcattagtgccgataatgataacaggaaggagatatgagaatgggggttcctgaaaacgtgcttccaaaaggttttgactagcataccaatcagttatgaatatagaatccagagataaattcaagcattcacacatttgttcacttatatacaaacatgatagtgctatgcctttataactagttatttgatataaattatctcccacagatacttaaatatattcaaaatgttaaacaaataatttaggggctgggttcagggaccttgtcttgtagtctctgtcttccctggaatttactacagagttttagatgcagtgagtgctcggtgtgtttggatgggattcattgccttgaaatgcatttgggtccaagaaatgacattatatcccgtttgcatttattgttcagcatttctgaagtatcatttcctgcctaggtgggaaacctttctgtaaacagaacactttctttctgatctgagcctgttctatacagttaagagagagaacagtttctcagtgtggcctcaagggcaactctctggataaggacgatgactcatcctcccagggtctccctgctgaaacgctgcaaataagtatattctgcagaggacgcagagtactgtggtacgagtaacagaaagcccaacccttctggacaaggatgatttgcagtcacaaaactgtcagccacagctgagaaaccccttccaaaggaagaatcagcggattaaatggtgctcctgcatgttttgccactttaaaatggtgaaagcttatttacttaaaattttaaagaatttgcttaattgcagagcctggaaggcaacactgaaatgcagagataataagaaaacatcagggctagaaaactaaggatcttggtgaaacatattaacagtgctgaaccaaaagaggtgtttagctatatttatgcaaatagcttgttttttgataatacttgtaattattataatcactgggaaatacaagaaaacaggttttttttttttttttttttttatctctcaacctagatggtaaactccttattgaatattttctccaaggatgagaacataagggacaataggtcatgtaaaatatattcctttaacaaagctttattaacttgatcgtatttgtcatggccatgccaggtgtgggagtaggatgagggcttgtgtatatagctggagaagagcccagaggtacccacaatccattgcggagcagccttgtaagcaccgggagacataagaacaagtaagagccccatacttgggggaggggatggtagtgatcaggaaaaagatagatacagagctgtgtttggaaagacaggcttgagttccctggatgaagaaaggtggaattaaggttgattattccagataaaatgagcagcttatgcaaagaaacaaagggtgagaccccattttccctttggagaactataagtaacgttctgtatagctagagcttaaagggagaagggaagcatgacaaggctgaagtggagaacaggtagacattgaaaggccatgtcttcagttgggtttctccagaaacaggccctgagataaaaactttaaggtcagtggttcatttgggaggtgattgcaggaagcactgttagaagaggggaagtgaaagcagattacaactgtgggcaactgggcatctatccactggggacctctggagagactgtgtgtctctgagttatctcacttgacaaatgggaactgggatctatatccacccaactcccatctatttttgggtgaggcctgctcccaggagagtaactccctgacactgggggcattcccctgaggctagaaaaagccctgaggcagagacgtacatgtgcttgtggtaacaagctggtggcatgtataagaaagatgagtgctaagaggataaggatgggacactaatagtatctagtctagtataggccatgtatgccatgctaagaatttaggcttttaacctaagggaaatgaagaaccgctgaattattttaatatggagggtggtgatgtgatgagattcgcattttagaaacattttttttttctggtaccagtaagaagaatggattacagtggtctaagaaaagtggtagaaataggcaattaggatgctttgcagtaatttagaggcaaaatcatgagagccggaagcattggtgtgctggtgaatgtttaacagttgactcacacacatacacagaaatcctgatttgtatggtttggtgatacttccagcatggccaagttccagctcccagtgtgctgtcactgaatgctgagtcaggaggaactagatgtgcactatcatctcttactccaccacaccactgggccgactgtgattgtgtgaagaataaggaaactatttgaagagaaattgagtagaatcataactgatgggggatgggtaagatgttatgaggcaaaaagaatgacactcagatttttggcttctataactaattaggtgatggatccttcattgagatgggaaatttagaataatgataatatcaatgatagtagtggcaatagcaaatagaatgcttgctatgtgccaggcactactttaagccttttaaacacattaacttagataattttcacaaaaatcttataagcgagttatcattgttataagcattttaccgataaagaaaccgagttgcagagaggtgaattcatacacccaagttgttatgtggctgagtcaaatatcatcaaatatccagttagtgttcagatttgcctgattgttttataagtactttcacagttgctcactcaaatccatcattctttttcatttattagctgaaatttttcttataaatgagattttttttcatgaattgtttggtaactttgatgtatagttttgtgacagaaaagcagggcaaatgcttgattctttccctttagctgccagtttcagaacagtgagtaggttcactaacacctccaaagatgaccactgagttttagaaattcatcaaaaagtgggtgaaggatatgaacagacacttctcaaaagaagacatttatgcagccaacaaatatatgaaaaaaagctcatcatcactggtcattagagaaatgcagatcaaaaccacaatgagataccatctcaaaccagttagaatggtgatcattaagaagtcaggaaacaacagatgctggagaggatgtggagagataggaatggttttacactgttggtgggagtgtaaattgttcaaccattgtggaagacagtgtgccgattcctcaaggatctagaacccgaaataccatttgacccagcaatcccattactgggtatatacccaaaggattataaatcattctactgtaaagacacatgcacgtgtatgtttattgcggcactgttcacaatagaaaagacttggaaccaacccaaatgcccgtcaatgatagactggataaagaaaatgtggcacatatacactatggaattctatgcagccataagaaaggatgagttcacgtcctttgtagggacatgggtgacgctggaaaccatcattctcagcaaactaacacaagaacagaaaaccaaatgccatatgttctcactcataagtgggagttgaacaatgagaacacatggacacagggaggggaacatcacacactggggcctgttggggcgtggggagctgggggagggatagcattaggagaaatacctaatgtagatgatgggttgatgggtgcagcaaaccaccatggcacatgtatacctgtgtaacaaacctgcacatcctgcacatgtatcccagaacttaaagtgtaataataataaaaaaattaccatatgaatacctgggttgtttttaacagctttactgaaatctaatttgtataccataaaattaacccctttaaaatgtacacttcaatggtttttagtatatttacagagttgtggcaccatcaccacagtttaattttagaacatttccatcatctccaaaagaaacttcatgaatacatagaattttttagaagatgtttgatgtgtttcaatgcattttagtagtattctcttgaggttcaaattgtgccatatttggtcagtgggagccccttttgagataggtttctataccaagttacagtgaaaataaaatgagagaatcattttcaagatgcctaatattttggggatgctaagattgtggtcatcaaccttggatgcacattagaatcactgcaagaactttaagacatcttgatacgtagttcattccccataccaattacagcagaagctctgcaggtgatatccaagcatcaatacttttaaaatccaccatgtggattccaatgtcaagtcatggttgagaaccactgaactttgaggatgtgaattaatttcctttctttctccctctctcttttcctactccctgcccagccttttctctctcaatccttgcttccaatcccagtcaactacatcactttttggcccagtcactcaagcaagcgaccgtaatcattggatacttttttttctccagcattctttaaatccaaagggttttatgaagatgaatggccagatcatatttttactataaaaaggatacttctgtcaacaatgtgaagaagatattgatgaatcaagggaaactactcactatttaagtgcttgtccgggacttactgtaataacctttacattccttagcatgatattgtaggctacccatgacccaatctcaacctctgttatcaaccttattacacactctaaatctctgtgcccttcagtgtggtcatatttgtatacattttctctatcaccttgccacagaaagggtggcctgtcatggacctgtagcattggcattccctgggatcttgctagaaatacaggatttcaggccccacacataggcccaactgaatccagtttgcattttaacaatattccccagttgattcgtaggcacattaaagtgtgagaacttttctctaacataccatgcactttccagcctttttgtccctccttatgccctgttctttctatacatgtcagttcttcttccccttttctcttttgattcatccttgaagccttagttcaaatgctgttgccctgaattcttcattgatttcccacgttcccacctctgaatagaagggctcttttctgcctcacggctttggtggtatgtttgtcatattattctcataaaaccttaatttgggttttttagtgactcaggtacgtgagagataactgtattcaaagctcttgagtgcaataatcatgccttattcatttctttatccacctagcactgtactttgcagatattagaatttatatttaaaaagtaaaaaggggaatacatgaatgaataaacctggttagagaatgtcagcatctgctttccctgaccctttctgtagaagtcactgatgtcttcaactggcacactcagccagtttatttttctatccagtcttgaccaaggaaagcagcttatattaacatcacatccactagttattgatgtctggaattactgtgaacatgaactctaccgtgtctggtgtgagctccgggcactgcatgctcactgatctgcttccttttccctattcccaacccccttccaatctcactgtgtgcacccagcatgtcaaactaaatttatttctatgcttggtttgaaatctcattcttcttctgtcttctaccacactcagttcaccctccctggatatatatatgttacatgaaatcactaacatagtacttttgaacactgcactttagactgctggtcaatgctgtccaccaacccacacacagacacacataggcacacaccacatggacaggttgcttcctttaaaccagtcttaaaattaccctgcttttttcctgtggctcctgcttgagcttattatggagaaatgtagtctttgagactttgacttgggctttgggacgtagggactgaagcttgcacaattgtggctttaccaagtactacgaaagctggtctattttgttaggaagtatttttttatgaagagccttagcactatgctgaggtatttgtgctctgtttgcattgtgctggtaattccacctatgctatgccttcttgtaactactgtcttagtctaacttaggttgccgtaagtacctaagtacataagtactatggaatggttgctttataaacaacagaaatttatctcacagttctggaggctgagaagtccaagatcaaggcactggcagattcagtgtctggtgagggcccaattcctcatagatgtcttcccagagtaaccttacacatggtggaagaggagagggatctctctggggccccttttataagaacactaatcccgttcttaagggttttaccctcatgacctaatcactcccgcaaagtctccatcttctaatactattacattcagggttaggattttaacatgaattttgggaggacataaacattcagtccattgcagctacttagggcttaataaattgattcatatctcattaatgtttctaacttatttctatagacccacaagtattattactgccaatgtatctcctaatttagtgttgtcctttatctctaaattgtccaaaaactaatggcttacctcacttttaggggcaggaactcagtcctccatccgttctagatgggaggagaaatggtctctccactcctgttaccttttgctgccatagagtattatatgaagcattgtcctgtgacatcctgtttactccagggtaatacgtctgctgacccaggttctcatataggctgcaatggtgtgccagatttggtctccaaagcaacaactctcttggattcatactcacatgcatatctcttatctgcagatatcactaatgctagtgtatctgggtctgaagggccttctaaacataagtcgtatgctgattttttttttttaactactcattttttttttctttttccagacggagttttgctctgtcgcccaggctggagtgcagtggcgcgatctcggctcaccgcaacctccacctcccgggttcaaacaattctcctgcctcagcctcccgagtagctgggactacaggtgcctgccaccacacctggctaatttttgtattttttagtagaggtggggtttcaccgtgctggccaggctggtcctgaactcctgacctcaagtgatctactcgcgtcggcctcccaaactgctgggattacaggcatgagccatcgttcccagccttaactactcattttatacgtctagccatgtctgtgttcttggactagatttactgatttttctttgcctatataataaattccactccctaaatttgacctatgacctttatctcccaacaccagttgttgttcttaactcagcaggttgttgtaattctcaacattgggagatcatgacatttgcatatttctggatacatgtcaaaattgttttaagaattgttttaagaataggtagtgggttcccattttattacgcaataggaaataattaaaatactgttaaaccaaatataagttggccatggataggtcaatcatgtgaatatgccatgaagtaaaggttgtaatgaatccaattctgtgtacctgggttgtaaataaatcatttttcagttttggtcatacaactattttttcccttcataatccaagtgacaccaagtagaaaagtagttcacaattttatcttagacaatttcatatccatcttagagcacattagcctcattagtaagaaatctgaacttcatcaatccatctccccttttggggtaagaatcaaactataggctctctggggtgtggagaagagagaacttttccttgaaacccctgcttgtaaaacaaagggagtcaaatgcctgccgccatgtgcagctttgggtcaaaattactggagattcctttagagagttagtctgttcaatatttagctaagtatgtgtgaaatattatgggtgatcttcaaggctagcacctttcaaacactagttctagaagacttttaaaaatattggtagtagagaataatgttacctctttattgagacatgcctgcagcacacatactgcatgcatgcctctcagttaggctccagatcagttccttgttgccatactttttaagttttattagcatctgcagactatgaaaactcttctgcatggaggagttggtgttgccaagtctcatctaaacttcatctaatttcagctcttctatttgttgaattcctgaaccccacacccatgacccaattctctgggagaacagtatactctgccaaatgttgccctcattggaggtgactggccatggaaatgagtaagaattggctaccgaatggttattctctacttggtttcttcgtggaagaaggaacaagaacatggctgctgttgggatattggtatatccaaggagtatgactacatttactcccatttaattattttccccaaaggccaacaacaatacctgctcactataagcattcagaaaacagaaaagtttcaagaagcaggaagaaaagactcacctatgatcccaacacccagaggtaataatttaccatttttggtgtatcttctttgtcttttcctatgtgttgccttatgtagatatgtaacaggttgtggtttaaaccgaagctatacccattgtttggagtcaggcaggtgcgataaatttgtaggtggctcaccagaaatctatttgcatgatgaacctacattaagcagaaaatataaccattgggtactgggtttaatacctgggtgatgaaataatctatataacaaaccccgtgacatgagtttacctatgtaaccaaccttcacatatacccctgaacctaaaataaaggttaagaaaaagggaagccttataagacctaacaaataagcaaatgaaaagatgctgaaaatcgttaatcacgaggaaaatgcaaattaaaattacaatgagatatcatgacacaaccattagaatggcccaaagtgaaaagtctaccattgctaaggatatagggcaacaggaactcatacactgctggtggaaacatagaacaatataactactttggaaaacactggtggcatcttaaaaagttaaacatgtacctacaatataatccagacatttcacttctaggtatttatctagtgaaataaaagcgtataacacacatagacttatacatgaattttcctaacagtattcgacatagtagccaaaatctgaaaataaccccgttgtccatcaacacgtgcacagataaacaaactttggtatatctatacaatggaatacacacaacttatatgaatctcataatacttgtgctgagtgaaagaaggcagaggaaaataagagttcatagtttatgatttcatttatataaaattccagaaaatgaaaactgatctctagtgaaaaaattgcagattattggtgcttggggataggggttacagaggggcagaatggaaggattacaaagggacgtaaggaaagatatggaggtgatgggtatgttcaataccctcctttgtagtgacagcttcacgaatatatacgtatgccaaaatttgtcagatactcactttaaatatgtgcagtttattgcgtgtcaaggacaggtcgtgaaagttataaaaacattatttcctggacgagacaccgtattagtcagggatcattggttataaattacagaaagtgacttggtctcaattaaattaaaaggaatttattaaatggataaggggaatttataggactgttaggaaggctgaagaccaagacctggaatggagcagaataaaagacaatttcaaagacccagaaaacaggaaggagaggactacctcatacctggtaccatttggttagagtgcctgtgatgcttgatgactacctcctgccattttcaggctagagtaatgggataatggacttacagcgttatcattcggttaaagagtaaaattccagtgagggagtattctccttggctgggagaaaggggctatggctaatttcttagggaaatcacagtgctattaggaagggagaggagatgctgggtaccattttaaaataaaaacaaaataacaaaaaacaggctgggtacggtggctcatgcctgtaatcccagcactttgggaggctgaggcagggagatcacttgagcccaggagttccagaccatcctgggcgacatggtgaaacaccgtctctgtaaaaaatacaaaaattagccaggcatggttgtgtgcacctgtagtcctggctactcgggaggctgaggcatgcttgagccgggggaggtcaaggctgcagtgagccaagattgggccactgctctccagcctaggtgacagagtgagaccctgcctcaaaacaaacacaaaaagaccccaaatgcctacactcttgagaacattcgcattctgttccagttattattgatccataacaaatcactcttaatgatatccatttttctgaagactttttcatccatatccttttttttttttttaattcctttaagttgtttttctcctttctttggtacctccttgagtagcttactaatcaaccatctgaattctttatctggcaattcagagatttcttcttggtttggatccattgctggggagctcttttgggagtgttgtagaacctcgttttgtcctattaccagaattacttttctggttctttctcgtttgggtagactgttccagtggaaaggcctggaactcacgggctgctgttcagattcttttgtcccacggggtggtcccttgatgtggtgctctcccgcttcccctagagatggggcttcctgagagccgaattgcagtgattgttattgccttactgggtctggtcacccagcagggctaccgggctctggactgatgctgaggaatgtccgcggagtcctgtgatgtgatctgtcttcgagtcttctagccatggatactgcttgggtgatgggttcaccagaatctcagaaatcatcactaaagaatgtgtccaagtaaccaaacaccacctgttcgccccaaaacaattgaaatcataataataaatcactcttaaacttaatagcttaacataacaaaaataatttcattatttctcatgtgggtcaggaaattgaggaaggacttggttgggtggttttggccccagctctctctatatttgcagtgacatggagctggaatagtaaggggctgaagcatcttgggccttcctgggaacctttctcttcttgtagcctcagttttctttatgtggtttctattcatgagctagtctgggcttccttacagcacagcagcctcatggtggttgaagtagtcaagagagaacattccagttgatgagacagaaattacattgccttctgtgacccacactcagtgtcacttccacctcattctgttggttacaaacaagtcacaagcccacccacattcaaaaggacaggagagataccctatctctggataggaataatgttaaggtcacattttgaagaagcacctgtgatgggagacattgtggtggccatctgtggaatatactgctatgcttgctctgaatagttaggacatttcaactcttctggtctcaaagtgtgtaacttagcatgctgaattacacaatccttgtgggatggtgtatctaaacatgaaatcagtcttctgctttcttagaggcagtataactttctatatgattcttaaagatctgttgaaagctcgactccaaattttcccttggcaatgcctagagaagacatgtcatggtaaagagcactagaatgatatttataaactctagggtcctatcctgtctttgttataatccttggcaactgaatctcagtttaactctctgtaaaatggaaattctatttctcctatgcactccacagctttatggtgaggagcaaataaggttgttagtgtgaaaacactaaaaatggaaaaaggtcacataaaaatgagatactgctattgtccttttaagtaattttaatgtttcacagcccactgaggcaggaagcttttcctaatatctgacttaaatatatttagctgccgtagttctctgtaaccaaccaacttgaagttggttgtgcttaattctctgtgttgaaatggtgacagagtcacatgctctgttgttttcactgtattgccaccatataatttgatttgtattctgtgcatcacataagcctattgctcagctagcaaacaattctgatcttctggcttctagcattatcattcaaaaatccccaaatcattttcctgatcactgcattgcattgctatggcttaatacagactttctgttttggttcattgtctctagacttattattttacatttgtctacattaaactgcattctctgtttattggcccagtcaccataaggtgccaatccatctgaatcatgccgttgtattttttttctacatagtgtgtatataccatataaaactaataaaaatctatgtaccttagaggaggtcatgaatattttattggttaaacttcagggtcagactaacacctcaaaacaggtcaagtcaatgttcaggataccaggccactgagcagagcagagccttccaggaggaaagcgagccagtattttccaagggaaagctttgataaaacctggttcactctataaatttgtactatattctctggtggcctagggctcataattttagaactctcattttatctctgtttaaatacccatgttatagtacctttaaaatatactttcctgaaaaggaatatgatccattcgaaatgagactgcctatgtcagaaaaccaattagctcggaccactgttaaaaaagttgcttaagaattaagcacatttaatgaaaattaaactcaaatgacggctgtcttcattcatgccaaacatgtttggggtctactatgtgtcgggcagttagttggagtaaaaagtacactgcagagatctgctttcaagaaaatatacgttaacaaaggaaaaactcagtgataaatcgttacagttcagctctatgtgaaatatcttgggatatttccatagagaactgcaggtgtacagagcgtggggtgactaattctgcctgggaagattaggatgtttgaaaagaacaagatattgagtttaagcgacagtattgaatattgagagtattgatcattttcttccttggctttgagacattgtggagtatgaagaaatcacatattcatagggaaaatatagcctgttatctccctggtcctccctcacctaccccagcttctggaagtgataggaactcctagaagattcctggtaaattaaagggatgatcaagaatatgtatatatatatatatacacacacacacatatatatatatacatatatatacatatatacatatatatatatacatatatatgtaatttcataatttctgaagcttactgaggatagtgatatgaaattatgtaatttcataatttctgaagcttactgaggatagtgagatgttataattggaggatcaggtagacgaaatttgcaagggaacttgaggtcacaattctaaagagcgatgtattagttaagtagacaaaagcagccagttgctgttttttttttttttttttttttaagatgcataggcctgcagggggtgtgtgataaaatattaatgctatattttattcatttattttgatgaaatcttaacatcattgactagaagagaatattgtgatttttgaaggattcttttccaaaacccaagtgacagcataagtcagtttccttcaactgataattaattatccatgataaggaagtatgagagcaacaaaaatatccctttccctaaagggctggtcatgacatgggagacagtcagtcatcaaaacaaggaggaattccaagaggagtcacgaggcagtaagtgatcaatctgagctcatttggttgtttatctttcctatattttgaatggctatagcatttattgtctcttctgcctaatttagcacttaataacatagtttctctttgtcctttaattgtttgacatatgaaggtcttgtttctccaactagactgtattatctctgtggcaggaattttgttcttggctggtctcctctcccctcacctgccagtgcctagtggagtgcttaatagccatctattagatgtccagtgaatacatatttgttgatggtctaagaggccatgcaatcaggctcaattattctacttcttcagccccagcttccatttttggaaaaccaagttaaacttggtgattttctaaggccttttcccgtcctgtaaatctgtaactaagattttaatctgcttatattttactatctggaataaacctaccattaacatcagtaatcatatgttaatattatacagatacctgctatttttcttaattgtgaagtcaccatattttacttatgtatccatgaaattataccaacagatgcataggttgcacatactgtgtgctagatattttaggagatactggagagccactggtgagcaatgtagttctcaccctccattgagaaaggaaggaaggaaggaaacagatcatttgacgataaccacaaagtgagatgaagggtatgctgggaagagataaccagatatggaggaacatgtctgagcacccaaccctgacccttgggcttctgaaagtcttgcttggtggggatattttgtctgagatgacttgaaggatgaggatgggtcaattgattaaagtcggggagcagaagggcaacatgtgtaaaggtcctgaagcaggagagagcatgacttactgaaggaatttcagttaggcctggggtgagattttgaaggagagataaggtaagacatgagatgcagagatgggctcaaattcaaacctttggagaacattaaaacatctattaagaagtgtggaagccactggggcagggaaacgggggagcaaggagatgacatgacagacttgtatttcaaaaaatcccagaatgttcccacagttatgttttatgttccagccattgaaatccaacacacattttctgacgtaatctaaaatcatccgtatctgacttagacataaaatgttttaagtttgttataagtagcagatgctcctaattgattctctgacacatttcaatgtttttcaacagagatgaaccataactgtcttaagtaacattaatgcaaatttaaaatagtgccactgattatttttgtaattaacttgccgatactcttaataatttgttttcttttaatacagttgttgatctgtaaaaatgttcagtccagagttagtattaaaatacagtcaaatacgttggtggaaagagcatagactttggatttggaagcatactggctccttaattgtttataatgcagacttgagtaattcatgtgacctctctcagtttcagtctcccttttgcaaaagaaggattataaatcagggttttggtaaggattcaaatgactttttgttacatatctagcaaacgatatgacccacattaagagctcaataaatattaactcactttctcctccccaaaggctcttttcagtgggaaatggaaactggggtttctctttattttatatcaaaagcttaataagagctattgcatgacaaacatcacgctaggtcttaagaatgggaatacgatttagtacctgatgatgtgaaacttagcctggtggggtagaaagatgtattacaaaaaatgagaaaaccgctttccgttctaatccgtaactttccttcacaggacaaagagttgtttcactttttggctcaaagtctttataaggaaattttgatcacgtctcagattaatcagagaagtagtcaatttaaaaggagccacagatgtgtcctgtgagaatggcttttatagttccaggcttttatttaggtcaagcttatggaagccacagtttaatccaaataaagttatctctgccaatttacattagacactttagggccagtatgtaattctaaataaaaattaataattacaaataactaataccattaaaagttgaaaagcataaatcaacaaatatttattgaaaacctactatattagtaataataacattatggataatatttgtgtttagaaacaaacctctatactaccctgactctatgtgtgatacttgatgatacttttcattttgtacatgatgaaactgagctgtagagaggtaaagacatttgtccaaagatacgtgacacataaatatagttgccggaattctgactcaggcaatttggtcctggagctcacattcattacctctatgctaccctgactctatctgcaatacttggtgctatgtgcagctcaatgagtcagatgctatctgccaggtattctgtgcactaggaatacaaagagaaaaacatgttagccgtgacctccaagaatacatgatctaattgagagacaaatccactgacaagcaattatggtactgcctaataattgttattatagtgtttatttccccagctcccaggagtaagaggtgggagatagacagggtgaaagatgtaaacaaaggaatgcactcattatttatttattcttcattatctaaggcggagtctgaaaattggcagccccagttttgtttgaccttcaggatttttttttttttaattgtattacttgccagcatttaaaagtcaggagattttacataaaattccagatttctggtttctactgaaatatcagaatatttggtaatactgggcccatagtacaccatgacaaaaagcaccctgagcttagcagctggcactcgctttcaacaaaaaatgtgcccctttattagctacaagctcccacagacctacttcaggcattcacgtgacctgttggttcctgtaaatagatcagtttgcagcctgctgtttctaaggttctccagaggttcataacttaccagggtatatagtaccctcactgatacctaaataactgaagtagctcagtcctgattgctcagagtcagagataggcttaccatcgtgctcatttctttcttccatttttttttttttttttccctgagctggagtcttgctctgtcacccaggttggagtgcagtggcacgatcttggctcactggcaacctctgcctgccaggtttaagcaattctcctgcctcagcctcccgagtagctgggactacaggcgcccaccaccactgcatcggctgatttttgtatttttagcagatacagggtttcaccatgttcgccaggctggtctcgaactcctgactttgtcgtgatccacccgcctcagcctcccaaagtgctgggattacaggcgttagctaccatgcccggcctgtgctcatttcttgtgtgagcctcaagtccctgggaaaagttctagcaacagtttgacataaatcatatgtttttgaaacatttgcaaaagtcagatattttaggtacagctggttaatgctgctgtctctttccattctgagttcattccccacacgtcccttcctgttaggggtgctggagtggctgtgggtatttaaaatattctcttctcaatgaattcacttctagataaatatttattttttattttaaatatatttttattttttaaacattttaaaatatgttttttaaatatattatattttagtttttaaaaatctaattaagcatcatattttttcttaacgaaggccctacattatataagcttcaatcttcctctgtccaggatgcttcattcttacctccaaaggcattggtgtgctggggtcagcttgtaccagcttttgagagacactgctacattatcaggagttttgggagcaggcttttaagcacagccaacaagaatgaaattatatagacataattaatacattattttataaaaatggaattaatactcacaactcattaagtcctagttatctgacttcattttactattatccatgatcttgaggttatttacatctgttttctgtgtatggtagaaatactacataaggggtgctattgcacgtctcttcccaactccatattcagtgatataatgctggtaacttgaaattggccagggtcggaacatttacaccacagaaattggcagtctacaaattcggactttttttttcctggagagttgactattattacatgttcatcaacacattgctatctgatggtgttgctgcatattgagactgagtggtgctggtaccatctttcctagagcaagcagcctgagttctggggacacacatagatcaagataatggaatggttcatagatactttattatgcagttggatgttgttttttaaaataggttttttctctctttcccttgtcatccataaggggagaatccagggatcatttcccatctgctgctgttcagaaaatagcggtatatttcacatcctgcgagggaataggaaaaggcatacctaacttagcctaagagggaggtggtggtgttcagagaaatactctgaaaaagaaggtaaacccccagaatttgtaaatgagatgcaaaagttctaaaatgcaatcagaaactaatgaaataaatgaggtcgacaacaggggtagatgacaacttacttttattgaactttgagtgcaccaggcattttgctaagcatgttacacatatttaatctcatttgatcctcagaataaataatctttgggggttgatattattatgctcaatttaccaaaaggaacctcaggcgtagagaggttcagaaacttgctaagatcactagctagtaaaacgttcaggccaggattagaacctcggttagtctgactgtagcaccccagccagctctcaaatataatgctttgcagcctgtacattacatatggtggagatgaaacaagatttttcaaagaaatagaataatttgtgactcatagaatgtagactcagatgcatgttcaagatcttgtagaaatttgtgtggtgtgaagttaggtagtaggcagattttaacacaataattctgtcatcttgagcaaatcgattaatatctctttgctttagtcttatgatctttgaaataatacctttagcattgctgtgaggaacaaatttttatggtaaagtaccttacataggatctgttacattgtgagtatataacagtatagctaatcgatattgaatgttttctagatggcagacactatcctaatacctttctatatgttagttaattcaattatatcaggcaggtactattattatcatctcccttttacagatgagaaaaatgagtaacagagactagacaagatgcccaagaagataacactttgtaagggtcagagctgggattcagtctctgcttgtctggcttttaaccacatgtcacagtaaacacttattattttattgttattagtatcaaagaacaataaattttggtttagaagacttcatccggcaattggttattaagcacttactaagtatcatcatgcttggggtcataaagataaaattaatattgttactgccctcaggctgataggctagtgggtaaattagatttgcaagtgaacaattataatactacgatatatattataatagatgagaaaacacctaacattgtttggagatgttccgtatgatcttcacaggagatggcacaagctaattttgataaagagaaggctcctgtctcacagaaaagtgagggaaagggtagtaaaggaaaaatagacaagagaaaaggcatagaagtgttcatttattgcttcagaaatatttgtggagctattactatataccaggcaaacttcagtgcggggaatataatggtaaacaagagaaaagccttccctgagctcctttagcaggaaataggatattagaggaaggacatgtggttcaagctaattgggccagggagcatttgagagggagtgatggtgggaggcaattctagaaaggtagagcagaattctggtcatgaagagcaggtaggtagaaagaccccttgactctgggtagaatctgaatctcccttcccacacatctgctgcccagaagctcaaggattgtattaatcagaaatgaggatgccattctatagagtggctgcacttttgtaggctggtgtgaatgcctttcactgctccccattcctgttagtacttttcttcctatatctctttataatcctataactccaagagaataattgaatagcaagggggggaggtggccgtgacaaacacgtctgtggaaatacagtctaaacggacaaagataggtctgaaataagagttctccagtgacagcatatgttaaaatttttagtttattattatcaattcattattatttattccttcttcttaaagatgcaagggagtgaggacaatagagagtgtgtttcagtaaccacaaaaggactgcaaaaaggttgctagatgaaggactgtggatatcaccaatttaccatttcatctatagatataagatagaaatttgactagtacccgagcagacagattgatggccaaagaaaaactacagatcctctaaataaatgggaaagataaataaaacagctgggacttacagaaaagaagttgccaaaacaaatgtgaaagacaatatcctcctgaagacatagagaaagagtggacctctgacaattatttattacagaaattagaaaactatgaaaaatatatttgggagcctttagagaaattgctatcaaactctgttctatggaattctaggattttgcagacatcctttactgtttaagccaagataaccaaatcatgatgaaaatacatgtataaaatcattcaaagaaacttatggcatcaaatatgagagaaattgagattatctgtaaaaagcttattaacatctgtgatattgctaatgtcattgaggaaagtgtgtgtaagacaagcaatctgacacaaaagtagaaatagaactagtgtctggtaatggggtccagagaagaatattcaccaaatctacttgaattagtttgaatgctgagattatatgaaatgtttgcaatttaatgaaaagtatgattgctgtggatcagtacaatttgcttgttttgtggaggctatcatcaccacaagaaatgttatttttaaaaacatttgatatatactcagtataacaaaaaatgtaagatgtttctatgtacttttaactgtcatcaaataggtggaatatgtttagtgatggctgtactgctaggggaaaaagaatggcaagaaaaatagtaggaagagaggattttataaaggtagttttaaaatattcaaatattcaaatattcgaggtatattatgaagaaaaatacaaaaattccagcatcttttaaagtagtattgattactgtcataaatattgttattttatcccagcgtgcatgaatgtgtttgtgttctccccacccgcttctttctttctctctctctttcaaaccagaaatatgcttactctctgagtatatgagtaacacatgcctattgtaaaaaaaaaaaaaaaaaaagataaagataaaaaaatagggcaaacataagcgagaaaaccaaactatcacccagatagtacgtctactgaagttttggtatttataattctagactttttcttaagcatatgtaatacaaacactgaaaaacaaactagtataggccttttcaccgtattttgccaatatatatgattagatgatcatgttcagtgactgcataatattccattgattaactctaccacagtttaatcaattctctattgatgttttttgatcataaagagaattgccacaaatgtgcttgtgcacatccttgaagagttattttactattatttatgacaaattgctaagttaaattgccagtcaagagggtatttatggattttttatattaataactatttcaatatttaattgaatatatgcataatcttttttgagacgaggcctcactgtattgtccaggctggtctcaaatgcctggcctcaagtgatcctcctacctcagcctcccaagtagctgggattatagttgtgagccactgtatctgaccataatcattttaagataagaaaaactagaaataacaaactaaaatcctaatactcggggcaaaaattctaacccctaatatttttctatctacatagattagatacatagatggcaatacagatagagagaaagaaacatgaaggaaggaaagaagaaagggagcctgggagggaggaaaggactgaatcacattgggattaattgtacaggtagttttacattaaaagtaatttaatttacctgaatttttaaaaaagataagtccacctgattgaaatcttaacctcggattaaaaacaaacaagtaaactttcctcatcacaagagatatcttctaagagcactgtaagtttcttcaggttcaagatggtgacctaagcacgtacatttgcatcctctttctcctgagacaaccctacaacaataaaaaatcaatcaatcatgaaaataataatgacatggtggcaaagagagtcccagtaaaggatgagaaatttcagcaaatctctgggaattagaaagcagatgggagcaggtctacttataaatactacctacatgctctacaggggctccagaggattagcagacagagtagagggcagaagtgaaaagtggggatgaaattggaagattaattgaagaacaactgaagcttctttacccatctgtcctcctggatacaaacacacacacacacacacacacacacacacacacacacacacacacacacacacacgatgaaggacaagacaaataggggaccattttagtttacctcagtacatatgtatttatttaggggatgggggcttaacgcattttgggagcaggggcttgtatttgttgtaatgaaaggtagttgctggaaaaaggaggagttagaattcaaacgtcggaagtcttgtctctaatgctgtagaccaaaatatctggggcttccagggtgcatattgctgacccataagtaaaatcttccccaactctagcacgtggaggttcgtaagactgacaatgatttctcttttacatacttgtctttcttatacagtaaaggtggccagtttatatgttctatacagacacatacagagctctgagtcacaatttccagtgaaggttcgtgatatttataacattataaactgtaaacttttccattctaaaatgtttttttcttattatatatgttttgctttggatactattttgtgtaaaaattaagttgtaaattattttaagtataatttttctactagttaactttatttcaaaatcattccttaacacttcttctatgtatctgtcatggtgaaattaaatttttggcatttcattcctctgtctttgagacaagacttaacatgtttcactttccctatttatttacctctttccttcttggtcttgttaaatgtattttcagtgttatattattgttataatatattttgacaattaagatattttccttgaagagttacttgtaacgtttgagttctaatttataattctattataaacaattatttatacatttctctattaactggctttgatgttcattttcaaatgctttattccgtgtccttttccttcttgatcttttatttttcatttaatttcagtaagtttgaaaaaaacaaaaatattttattcagaaacaacacatgaatattacatgttgtctgcctttcaacacttgcaaacactttttgatgcccttacccataagtcaacatttacttggctataaaatttgaaatcatatttttcataaaacttactagaaattgcttgtcttttactgtttgtagatacgtctgatgttagcctgattttttttattatatgtaaccatttaaaatatattcttatataaaaatatatataataaaattatattagtaagaaatatataattgttaagcggatggccctccttgctgacaccattggccttttttgctatttcatcacctttctgagggagcagccttcttgataattgccttccagggtagcacaaattggtttcatcaactaataatgattttaaaatagacttcatcaagtctgtttctttgtttctcatatagcatctacagtatggtaatgctgctatctttggaatagttcatgaggccattataataccttgacttactgaataatagcaaaacatttttatttggttcaaactattgaaatgtcctctgtatctgactaaagcaggttcaggaaggaaataactctgaaatgtagtctatcggcctaaagatttgtaatggatggtctcgtggagttcatgcaataccttttatatcagaacattgaaaatagttcattaaaaattaatactttaattacaactcccaattcctttaaaatgatgggcttatgtttgttgtaaaaagagataatgcatttgaaagtgctttctaaacaggggtagtgggtgatgtagtgggacatagatgggtttgatatcaagagggtttggattcataacaaaggaatagaaaatggctacttgtgagctgataactttgttttgcttttatgtatagggacaatgaaagtacttagttaattgcattttataactatatttgaatgtatatgatgcatgtagcacagtgccaggcacaaagtagctttttgataaaagttccctctcataagaggagagactcctgttagctgctattgtgctagaaagatgaataaatagatggagaagaataacatttatcattgaaactgatctccatccagacattcctcttataaaagcgatgattattaggtgatgaaaccaatttgtctacactggaagacaatgataaaaacacctgctctctcagaaagttagtgaaatggcagaaaaaggcttgtggtgtcagccaggaggactgtcagtttaactaggtgcttccatctgaatagtgacagtgttctgaactctagacccttgttgatgtcttccaacttctcattagccaaactgggctcagtgaagctctgatgcctggtaggaggtggccagaagatgccagggattcacgtagtagccaggtaggagggagggcacctctgccctgtgagatgtgggagtggagacattgatttcaggacaatatcagaggctaggtggatttctaaatagattgcaaagaaagagggacagacaaatcaatttcctcttatccctttttctagtgggaagaagagaacctgacttctcagttgttagttagatgaccatgtgaatttatgctctcagcccaagctgcagattgtttattgatggtcccatgtcttatgctaagcaggttattaaaggcttctgaaatgtctgagatacgaaaaaaaatattattggctctaaaatataaaaataaaaactgcaaagtcaaaagttccatttcagtgaatatctccaagatgtgctatcaagttaagtttattaactgttaacttttggcagtcttcgaaaacttaactacatttgaaaactactgaaatttgatttgatacagttctccaatatgcagcgtgattgatgagatattgcaaccaataataaattaatgatacaagtgtgaataatatcaaaactaaaattataaaactcctctaaatattatatagcaaaacatttataataactgtgggatatgagtgtattataatacatttggtatgacgtgggatggaaactctgcattagaaagatggcttagagtctacgtagattttaaaattactctagtaccaagtgatttttatatctttttctgattgaaagctctaaaagcttaaaatgttcttttgtgtgtgtgcagaaaaactccacaagccaggagtctgtggagttgacttgttgagttgaggagttgacttgtttctgtgaatgcgtatattaaggaaaatttgagtatattgcccaagctctcagggacccatgttcagtaacatttgcagcatctaaaaatagttggcatttcctgaaatctgagaggatgcaaataattaaatccttgaaatgaaataatagcaagggagtcatccgttaacatagccaccagagtcttttgttataggaataagcctaacttttggcagtgacttaggctgttaagctcaacatttgcctaatttatcatcttgtttgtgatcgcatttatttgaaaggggtctgacatcttgtctaggtttttggaatatttatgatgatccattttttataacttgaaaagttccgctaatcatattgcagaatctgtctatttgtgtctgttttgtcttggcagcaaggaagaggttcaacagagtttgctcagctgttctattaccagtcccatgtttctgaatctcaatatttaatccaattgtcaaaattcagctctgactacaagtcactgctgtcaagactcttttaaaaagcactggtggatactgttatttacctttcttgttcttgattatgcatgcctcttagatcgttggctcaggcttggtcaggaaaacagcagcttctctaggtatttccagcaggaagaagtttaatattggaaattagaggctcacacaattgttgaaggctgagggagtaaaagtcagggggatggatttcaggaaatttaccatctgctggtgcccatgttcctcagtgcagttgccagagaaaaattatgctctccatgtctagtgcaatgtgaatctcttgcagctgcctctcattggtaggttctagctaaaaccctgctggcaatggaatctgggaaatgtagtttccagactttatccccaagtggtataggaaagagttatagaggggtgggaatactgcctagaatcaacaaatgatatctggttcgtaagtatatctgtaatatttttgtccaatcattcaaaataaactggtcaagattagacctggaacattcacatgatgaaaaatagagtgtgggcatgctaaatcattcaacaaacttttattgagacctattggaaaaccaagttgagttgtggtcaaaacatgggaagtattgaatgtaagatttttaatagttcatatttatgtagacggcttttgcacatggacagaggtttcatttgttttgaagagaaggaagacgaaaaaagttgatattccaaataaagcagtaataaagacaagcacagtgcttctaatcatttcccaactgtatcttttctcattattagtggcttatcttttttaaaaaaattctcagtcccacagtggagggtggaagggatgctattagttctgtactgtatattaaatgacatcagaatataagagaagaaagttagcattgatgcaattcataaagtggccttataaaaatgaacttggagttgtctaccctctgaatcattaacccgttactacagttaattaactaaatcttgatcctttattagagaattctaacatttcagagaaatgtgtgactacatgttatctgatctccttggaattattgtccctacatatatcccataacgtatttttggaatggaatgacattggcaaaggggtctcagtcatgtgaatatcgaactcattcatctgtaaagtgctcttttacaggaaaaataatagagactgagttttccgggaaattgcttcagtgttctctatttatatagagactatcagaatttggctgttgcatcatgatgccattttgaagaatggagtttaaattaaatagcaagagttacagaatcttaagcttggaggtgagcctataggttatctagtagaaccagtcaactgatgcttgacttccttctacaatattcctaataagaaactctgggcctagtttgagacccttaaagtagttcattctaacttcgaatttacagacctactgtagaaattgtaatggtttataaacagaacatctttattgtatttagctgaattctgcctctttgtaatgttgacctatttttgcaaacacactctttgaagccgtaaagaacaaacttaattcctcttccatatgccagcctttcacatatttaaaaatagttagggtgttgtccctgattcttcctgtatctgtaccaaatagtctctagtttctttaaatttctttaattgttccctataaatatcatggttttattaccttttgctgtgttaatagcgcacattacttttgcttacatccacatctagccacaagaaagactagtaaatatctttattcagggctggaatgtgtgtagctaaaattacattgcttttaattatggaagaagtagagagcacacgtctgaagataactaacagtcttttatgtgaacatttcacccacacttacaaattctactttacttctcgttatactgctttctcccttatactcatttttatccaatactagtttagatttgccagctttcttttgaatgtttttttcttcatatctttatccaatcgtttattttaaggctttccctatgtaaaatgataatctttatcttgtgtctgtaaactttaatgaattgatgttggtgaaggttactgctatatttggattttttctactatagtattttatatgttctatttatcctttttctggttctttttccttttccatttcttacttccttttggattgttagtttctcttccttttcatcattccccatttttctctctactagattggaaataaagtctatttttagtttgtaatgattatcctaataatcttaaagtgctgtcagtgtcctccaaccaaagatctctagggatatacctgtggtcaaacaaagtttggtttcttgtggcaacgatggggacagcatatcctgaggaatggtgaggtgtctcagttatgagagtgttaggtggggcttgttatgggattttggtttgttttaggtaattttgaggatgggctttgtctggattggatgctctcagaaagtagggccaattcgctgattgggaaacaatgatgttttaaccagaaggcagaaggaaaggagctgggctaaaactgtcattggtaaagaagcagcagccatatatattagccaggatggagaatgtttggtcatgtttgtggtttggacaaggttcatgtgtttcctgcgctcagatatgattacgaagcggtcctgcttttgtattgctcaatcataatcacagagtggccttgcctggtgttgttgttatgtgagattgttcagttttaacaaaagaacaccatggccttgctgtgttagccagacctcctccgagctaacagcagtcagggactgctttttttctttctcattattgtaatgattatcaaagtttaaaattgatttatcatttttcccattttcagagaaacagggactttagaaaatattaactcctatcatgtctcttgttccttaaatgatgtttgtatttaggacttcagttttatcatggttgtttttaacttctcctaatccaggttactactgttattgttgttgttttacacactaaatatttacatagtataccagcatgtttacctttttatttgttcttcagtcctttcttatacttcaggccatcgttctgggactactttacttctacttgaattttatcattgagaagtaccattgtgggatatggtactgtaagtgataactctgaggatttgtctcttttaaaattattggaataccattggagctggaggccattatccttagcaaactaatgacaggaacagaaaaccaaatacagcatgttctcacttataagtgggaactaaaagatgagaacacacggacacatggaagggaacaacacgcattggtgcttattggagggtggaaggtgggaggaggagaggatcaggaaaaataactaatggatactaggcttaatacctgggtgatgaaacaatctgtacaacaaacccccatgacacaggtttacctgtgtaacaaacctgtacatcctgcacatgtacccctgaacttaaaagttaaaaaaaatcagtaaattaaaaaaaataaaattattggaatattcttatccgttatcttttcaaatattgcctcaccacaattttaatttctcaaagttttaacagactgattcatacctgtctgctggttttcataatctctttttcttttgttatgctgtaagtcttatatatatatcaagcaaatttatattgtaagtctgataataaccaaatctccaatctttgtgggcctgattttgtactttgctgtttctcttagttcttcctcatagttttcctgatgtatttactgatttcttctttattgtgagctcatgtttcttggaacttttgtgcccataacatattaagaatttgtattgcttcttcaggaacccggggacactatcactccagcatcaaataacctcatgtttcatcttgggttttttgggccatatggatagtgtgaatttagaccccacgcccacatgagtgcagacaagtggttaggcattgtagagttttgtttgtctgcctgttctatgcaaagtcgtgaccaagacagacagaaatctttaccactttttactagtttacctattgaaagtgtgtccctttaggaactgtatctatatgttggatctttgatctgaattcccatgcttcttggatctcagggtttatttactgtccccacacataatgcattaaaactcaagcattaaatcactatcccagagaactcactatgatatacttaagagtctgtttttgatgtgaaggtgatatttttttctttttaatacagatttcattctaccactggatgtttactttattatattttcttatataacctagctctgttttaatttcattaagacatagcttcatgtatctgagccaatattcctttgtctgagaggcctttcctgactccataatagaaaataagatgccccttctttctctcttactttttacatgtgaatttcctctactgtatttatgtaaaccatccctatcccatttagaattttggtttgtttgttttattgcccgcatttcccagcctacaaagtaagatgtactagtgcagggacactgtgtgccttgtttacccctgtagtcgtagtacccacacttacagtgatttcacagtaagtgctcagatcccctgggatcccttctaccctttgtgtgtgcctatccctcagctactctgcactttccttctaatgcctaaatagtgtctgtgcctctgttcagagaattaccctttggctgctggaactgattcgcttgctcatgcacgcagagagttggaaccacctgggagtttacatagccactctgggtgggctttagccaaagactgactggtgtgagaatactggaggtgcaatttacacttcaggctgaagctgggagcttacatctcccactccctcactggtcttttcttggagtgcttcctttaaaaaaaaaaaaaaaaaaaacactcgcataggaatccttatttcagagtcggcctcttaggtctgccaacctaagactgctcaataaatatttattgaatgaataactaaatatatcttcgccatcaaacttttcttgtcagactgttgtgctacctcatattttatctcatttcaaagactattttttcttggatttttattcaagtcacaatataattcactgtatcatatactttatataacaaatatttttttctgcttatcaatgttgtgcttcagtatagaatattcttgtgtcatatgctgcaaagttttgttagcttgtttactgtcattgaatgagaaacagttgatctgggaaatcagttgccatttaatggagttgaacaattattgttggttgctctcggtgtttacctggttaccattcaaatcctcctttctcgactaaactggcaggcatttgtatgtttgaagctcttacctaattcctcagtgctactggttattatttgatgttggtactaaaaccaggaaggaccttttgccacctgggtagtgttgtatgttgtgtttgtgtgtaggagagggagggctaatttatttcttgataatttggtggaatatatgcgtcatcatttacttcatgtcatactgttttatctctgtgaagaggacgcatttttgattcattatcacagtttagtgttcaagttattgtaaacacattgcattgcccttggtttctctctattccaaacatccaccctcagtgtttgcagaattatgttctttaaataaaatcctattacttcatccctttacatcccttgttagatccagatttcttttgaggagaaagtccatatttcttgtcttagtttccaaggctcttttcaaatcccttcccaatccctttttccagacttggttttttccccttaacatttattctaatttctatttggattcattttcacctttctctgattatgttttgctctttcacctccattcctttatccatgctcttcctgggcctgaagatggattccctagctttgttacttaaaataatcatcaccatagtccatgcttcagtttaaatacctcttcaattacattttacccagcctgtactttctggctgcgtcacacagagttagttggctcccttcagctaagccctgctgcactgtgtttataccacttgttgtcgctgggcttcttgctcagattccactttaggatctattcccccagttgccgaaaatgcatttcccttgtttgtgaagagctgccttacccaaagtcatacctccttctcaggtgtggactgcattccagtcactcgttggtataggtgatatgatgacctgacctcttgtaccggtttaggacaattctgaacggcgatcttggcttcagagctccccatgagatttgttgaggacattgttgaaactatatggcaaactagcctttccctgtgccaaacctctcttccttctcttcctccatgggtgttgatccatagagcaccccctaataaatttcctgcataattaagcttctcagaatctgcattgcatggaaactgaggtgcaacaccacgattatggcttattaaatttgattttcatttccctcccattgccgtccctacttaactgtgaacttctttaggatggtaccatgatgttaatttttgttttctaaacacttagcatcgacctggacatagtagatgatcaataaatatttctcaaataaatggatggatggatattcttttattccgactagtttgacaagacaataaatcttgtctattttattacttatcctattggcttatatgctatcggtaacttgcaaaattttcttatcccaaatattagtttattacagtgtctacaatatattacactgattctgctttccccttaaatataattaactgaataaattgaatttaatcatccaagattaatataaatggttcacataggactacaatttcaaattccatatgtacaaagaagtcaattttttttcctctaaaataaatctgcaagtgattaagtgatttctttctgaagttaggcttatttttggaagaagagaagctattttttttgtataaactaataatgtggatgacttgaattacttagcaaggcttactctttctgtaagtcaaaaatttccattagaactttcttaggggctacatgcatatttattctacacttgaaaggacgtctctgtttatatatactcagtatactcgagactgtgtattctctataatgatagagatacattttagagagggagtgtcatagaaagtatgttgaattaggactcagataagcccgatttgttcaggtcctgataatttcttggaactttgaattattattattattttcattctgtcttttaacattcataatgaaagcattaccaaaattagttaatataatagtgagaaaagcctataagtatgctattttcatctttatcatacaaaatcatggagtattggaagtccaagcaacttacttaaagatcacaaaagtagaggagctggcatttaagactgagtcaaagttacacttagcatgaaatttcctttaggggaaaaatatgaaatgggtgatatttgtctctgaatcccacccttgtttcctatcaccaatcctgctaataatcttaaaggttatcaaatccctgagaagtgcttaaagtatggccccaggcagggatgtaaacttttttttttaaatgagtaattttaaaagaccatcctttaggttttggctcttttccaagttgtcttccatactacgtagctggacaactggaatgaaatgcccaagataatactcagactgtcttctttctttactcctcctctatccttttccccttcttgctacaagaagcggtgaacaaaaggagtcttactataacactttggttttccaaaaccttgtttaggatgtatttttactataattaaatgacaaaacactaatatcatgctgagtatgactgattggaattcctcattcactccctcctttttctgtgtactgtcctattccgcaaaggctggaaattgaaaactgcatttcctagacccccttgcagctaagattctacatatgaagtagttccttttaattaaatttcctcattagaagtagaggaggagttccgcttagaaggtggacttcaggcagagaccaaattccagaggctgtttctgctggcctatagagattataaatccaagaatgtctaggaagacctatggcaatcaaaatcaaggtttccgaaggaaacaaccagcttagttgatgtccacaggcagcttcctaatccttggatcacatctgtatgggcagcatagttttatacctaagaatttcagtgatggctcctgcttgctgctcctccggggcttccactggttttataacacctaagttcctgatttaaatcttcctttttcttcatataactagaatgatttgtgttccctgctaggtgttctgacttaaacaaacacaaattataaatacttcatagtagcagttgttttttctttgttgcctttgaagtttagagggcaaatcttacaccagtggattatttacactgaataactacaaccacctaggtataaattgtcaatattactaaagatggtattaaatacagactttctgtaaatcatgggctaaaaagtgcttttgccatctagctttcagtgctatagcctattctaagaagagttctctctgatcgttttaaatcttcatttcctcttttgacatcactttttgccaacattaaactaaagtgagtggggaagcaggtcaagggtcaaagaacagaggtcagaagactggttcgaaatctatagctcagctcttaaccacttgtgtgagtgacctcaggccacttcattccttatcctgaggctgtgtttgtatctaaaaaaatgaggacactgataatctctgaacatgtggcacagaatcatacataaaactaacagtgtggtcactggttgggctggcatgtgaatcctggccacctagagtccttggagaatttgcactgattgactgtcagtctattttacgtggccagagttacttgggtaaagcattatttccatctgaccttgtaaagcactagatttgggtcccgctcctctatgatttgcttataagacagatcaaagagtgcttcacaacttctactaattcaacctataaaaccacattttaataggttttcctattattcaaatgccagttttaaatattagcattattcggaagctctactgtgtttacaaaaaggaaacatcagataattaaacttaattattgaaaagatcatgtcttttgtgaacattgtctggatagatatgttttaacttgccgtaaaacaagaatcatcagtatgcagtgaggaggtattgaagaaaattgccttagaaccagaattgcccctctggagtcagcgcttgaataggctgaataatgtattggttaagaacatagactctaaaatcaagttgcctgggtcgaaacttcgctaccgcaatttattaactgtttgaccttgggccagtagcatcacttctttttaattcagtttattcacatgtaaaatgagaataaacatggtacccatttcatagggtggctttgaggacttatcatatgagaagttttcaaaaatttataaagtgcttggcacacagttaagtatgaatatgttaattacaatactgttttgttaagaaacatttgccttctatctttctgtgccacagattctccagtggctcagagtgagtcctctatactctactttattaacactttccttgaccttgctaacattttttcaggtagaaatctttctctgcttaatgaattctatgcatttgttctctacatatatatatttttttctttgctggtcgctaggtcagttgtataaattatctgtaaaatatctgctaatttaaggtaatgtttctagtattgtttaatgtgacaaataatgaaatattttaataattttataaatatatactttacttataaaataatcctatgggtcaatttcctttttattgtaggttccagttcagttgaagaaattgatcttcctgtgatctgtaggcttcttccccttgacctcgtattaagggcagtctagacagaaaacattaagcaattcccccaaattcctggtaggagggcaatagagaaggcttataatagtcctcagcaacctgggggtggcggtaagaggatggagatacggactgaaatgactagcaagcaattgatcctagtaattttcaacaccttgatgacacttttggaatctaataatcccctggatttgcctctgagacactaacggcttacctacctatcttttgggtctcaggtttttagagcatgagaggggcaaagccctctatcctgacttattgattggtgcctgattttctgcctttaaataactagctttgtttcccagaactgagttctaggttccacattttcctgccttatcttggataaacttatctagatacaactctgcttctcaagatatgctactgtcatatccaagtttatgtcgttagtcaattctcccagattatgccacttgtttgatttcagcatctgtccaaaattacactagattctgaacctagtgagtagtattgaatattgggtcttacattttgttttagaattacgtttcattaagactgtttatattttggttcagattatagctatccattactttctgggctactgttttgggcaaggactaccctgcctgccaactaagttactccctctagttcagtactttatccctcccagcatgctatgtgtctgctgaagtgtcctaaagccctcctgtaaaactttcacagacactatcttcttagtatctccatatagctcttggatttctttgtggaaatgtgtgaattggacaaaacattcaggggattggattttctaaagcttagctcaatggcctccagagaactgagggacctgagtgtttgcacaatttctgtttattcactcttttaaagtcagactttcctattggaatgggtgggatgaaaatagaaatgaattcttataatttttttatatagcatcttgtcttgtttctaaaggatcactttaggatttagttgttatagtaacctggaaatttgaatcatttctgtctattaagatgtattgttatggagtatttgatatttttgaagtactttataatttcttcgaatagttattcctcacaatggacctatgatatagagcattagtatcatatcatctttcctctgttttcttttaggagaagtgaacaacaggccatttataacttgtcaaatattaccaagtgagtcagtggcaaaatgggattcgaaatccccgtgcctctgtccctgatcagctattatttctattctaccaatataactgtaccatttccctatttattgtttagtctgccacttcttacttcaataaaatccaattaaattcttcaatgttacatctcccttctcccacactaattatttcttttttgtttacttaatcataagcattagatgaagacttgcctaatagtagaaggatggattaaattatttctttacacctttctaacattttttaccctttgattttacgtagtaaaactagatttcagaatatctaatctttttgatggttaagttaaatgatcaagttaagttaatcaagttaaatgattaagtcaactcatacacatttaattttgtaaatatccagaaacatatatgatggtgtaatttgtctataaatttattgaagcctgggatcatggcttctaagcaggaagggagcatggtacatgcggtaaaggacctttagattaaccttctgcctcttttccacaccaaatatgtgactttgggcagcaatttatcctcttcaccctgatgttcctcttctataaaagggcaatcatattacctcatagaattccatgaagttaaactgcttgtcatttagtgtaccagttagaatccagctagttaaacagaaaccacactaggtatttagcagaaaaaaattaatatagagaattggatatataaatgttggagagctaaaatagtaaaaaggaaagtaacccaaagatagctgcaggaagtatctaccatctctaagtctgggaatataaaagagaagaggttgaagtaaccagagagtaggagcttggaagagggcctggctgaattggtaccagctgcttctggtaacttaggatctcagaagagagaccctagatagctagaactcagacctctgaagagacaaaaacacctgaatacttctggtacctttgagttggcacaatgaggctggttctggtaatttcaagaagaaattaaactgaaaggaactggggcatgaaacaaaaacagctccctctcttcccccttgctttccaatctctctctagcgtcttctattggttgaagctaatgggaagacaactggcaaagtgtctagaaaatatagttttcagagttccagccttagcattgtagaatacacaagggtatatttgaagctgagagacaaaagactaaataactggtacaaataagtacaactaaaaaacaaaaccataaaaattccttttggttttagataacatttttgaagtctagccaaattcatcaatatatcatgattacgttgtattccttttatgaattgtggctttaaataatgacaagaaatggattgttacataattcatgcacggacccccagaaaaccacatccatttccagtgaccacttttctcttctccttcctcaagtatgctcaagtattactctgcacctgaatgagcagatggttttttctttgtgaggcatgtgtttcataaagcccagtaaaaagtagaacagctgcagatgggtgtcttgaaactcccagagagactgtcaaacaagcaagcctccatgtgagtagaaaagttcttagattgctaggactctcatttatttactgaatcagaatgatgttgaggcatttttttttgagatggagtctctctctgtcgcccagatgctgaagcatttaaatacttgctttgagaagtgtgtgatagaatcttatgctgtttacctgatacctactgcatggattaatctagtgtttgtttgggtagctagactggatgaaatataaaattatgtctagtatgcgaacaagactagtaatactttcaataatgtgctcatttcagagaatgtatatttagatgtcaataaaagctgatcttcaatttttttcctgtttttctaagttaacaaaacaaagattgaagcgaaataaggaagttttagaaaaaggattctgacctgaagtaggtgtagtatgattggccaatataatttagttgatattttagcaactgtgcatatatttggagaagttcatgaggttattcttgtcgtttctgtaagggaaaggcaggattctttatcactttgttttggtggagaagaggatactaaaggaactggataattgtacacttaagtggatttgtaggtgtctgaatggctatatccaaaatgcattggataatggaccatataaatatttgtgtaatgggagcagatgtgtacatcacatagtattactaccttccattctagcctgttaaatttgaaaatattcagaggcaggcataggagatacgatgctcaattttcagatgttaaaaacctggaccgaattgctaacaccagatgtcaaacgactgcaaggaccacaagaacaaaatgatccaatgatggatgagtctgctaataaagtcaattcttcttagactacattgtactggtgtccaaatcaagggagaaaaaagtttcgtaactcttcatatgtgaggtaagtggtgagaaataatctttctggtgaacatccttactctaataaatccatttataattgatttttgctggacctcccaaagatgttattctgaggtattttgacagtcatagataattatctaactgttggtcagtgaatgtttctgattccccacatctccaatagaagagggggcttgagagggtaagccttctgagggagcatttattctatgacatttaatgctacaaaaagtgctgaggtccagtgactaaggaacatattagttggttttgtttttcctttcctccaccaacagtcttgttcctgggtttcagggaaaactagagtgtataagaaggctgccagacatgagtgccacaccccattatggcatctctaagcatgtttttaaatgcctgatgcctcatatttatgagaatgtatgcagtgaagtcacacctggttttcttcctctccatcaaaaatggcagcagcaataatggtcactttctgagtgttgattatatactgaaaactacactaagtactttacctgcattatctcattcaattaccataataattcattatgaagatgagtaaaccaaggctcagagacatgagcaatttgcctaagctcacctagctagtcagtggtgaagccagagcttaaatccaggctatctcactctacagaagtatctctgcctgtagtttgaaaagagccatgcaccctatttaggaagacttaggtcctaggacaggtctgcctaacctaatattgtgatgaaacacttcacttgcctaggccttcactttctcatttgtaaattgagttggctgtgtggaatgatcattatggtatcttgcaggtctaatcttctaaatctaaagttcattgagaatttggatttcttttatttttaagtcagtgtaaatgaaggatcgactagaacctgtccctttgagaataattacttctgggggaaaatttgagtgctgatttccccagttttcaaggcaagaggtaataagaacagatgaaatcaactctctgatatgattttggaaaaatacatcaaacattaaatgtaaaaattacagttatttctcctttgggtgggtctcaaaattattttaagaggtttggtcttttatagacatgtcagaggatatcgaataggattgtgtttctttctcagaattttggctagagctgaaaaactgaaaaaaaaaatagatgataaatgcctacacattctatagagagctgctagctaaaaagtcggaaaacttatatatggtgttaaaagtcagttaccggaaggaagtgcaaggggagctttagtggagctgctagtgttttgggtgcccgttatatgaatatgttaactctgcacaaattcaatgagctatacatttgtgagttgaacattttatgtgtttaagttgctttttttttttttttttttttttttgagacggagtcttgctctgtcgcccaggctggagtgcagtggcgtgatcttggcttactgcaaactccacctcccaggttcacgccattctcctgcctcagcctcccgagcagctgggactacaggcgcccgtcaccacgcccaggtaatttttttgtattttttttagtggatacagggtttcgccctgttagccaggatggtcttgatctcctgacctcatgatcgcccgccttggcctcccaaagtgctgggattacaggcgtaagccaccgcgcccagccatatgtcaatacacttttaccgaaaacatatcagaaaggttcagctaccaacaactccaatcaatcgcctccaggatatataagagaagattaagtatttgaaaatattactgaataaatcattacggtagagagttgtcaactaaatagaaagtacacctttcctgaccctcccctccagtatattagaaacttccatcctctttatcctgtatatatttttactgcactaatcaagagactgaaaaattgtgccaagatcatttcagtatgaagtttttgccagaaaaacccaattagaaaagtgaaatggcaaaactaattcacactaatatattctagactctggaaagcctctccctagagaatctgcattctcaaataagaccattggaaaaagtagtgcagaaaaatagaaagaaatcttaagtggtggactatgagggatcaggaagggagatatttgaggttcaggatctttttcagataaacgtttattctgctttgccacagataaaccttttctatgcttgttagatttttaaatataggccagaaacccaaattcttgtaaatactaatgtataaattaatatgtgtgtataaatagtcaaataaataaaatacaataaattatgaccattgtcaaaactatgttcaagagaatgtacagtaactcatttattctttcaaaaatattcctactgaggacttataatgtcccagtcagtaggcgcaattccatgaagaaactgagagatatattctcttccttcatgaaatcttagatttggcaaaggaggaagacatttaaaaattgttactcaaataattatttcattataagcttgatctacagtgctgtaaagcaaaatagagctactcaattttcttgaaatagtgttttaaaaggtaccaaaagtatatttactttgggcgttgggtattataaccctagcgtcagatttttaaaataaaattacgaagaaaaatgccacacaactaagcttttcttactgttacactcagtgttctttattcctttctgtgtgtgtcagagaggtgtgttaatcctatctaataccacagcatatctattactatgcatctgatgttttgaagaaaatttcttcttttgaaaacacatttctgtttatctttatagtcttttgaaaattgtgttgccatagctgcaagatatttattttgatcctttttccttaattgacagggaggttgtgattcagtaaggaacaatggttttgtgaattacttgacttaatttttaaatgagtcagtggtaaagtgagttttgaataatgaccttctttcttggcttcatgtttattttctatttaaatgtaatgcatgactttaaaatgcttagacacaaatgaagatgttttatattgctctgctttcaatgtcagggaaaacaaaaatctaaaagaaatatcttttaatcactgtattttccagatagtcccaaaaccctttgcataggacatttatctaaaacaattataaacttctcagcaatagagttaagggattaataagtgatgaagatggcaccaatacccaaatggcaaacccaaaattatattgtctctacattatttattctgggtttattcattgaaaacataagattgttgatgaaaatttacattcactaagcatgtttttgtttttgtctgaatgtgatgattcttactttaaaaacaatgtgtagaacagaactggaggaatcacattacctgacttcaaattatattatagagatatagtaaccaaaacagcatggtactgcataaaaacagacatatagacccatggaacaaaatagagaacccagaaacaaatccacacactgacagtgaactcattttcaacaagaacatacactggggaaaggacagtctcttcaataaatggtgctgcaaaaactggatatccatatgcagaagaatgaaactagacccctacctctcaccatatacaaaaatcaaaccaaaatggattaaagacttaaatataagacctccaactatgaagctactgaaagaaaacattggggaaactctccagggcactggactgggcaaagacttcttgagtaatattctgtaggcacaggcaaccaaagcaaaaatggacaaataggatcacatcaagttaaaaagcttccacacagccaaggaaacaatcaacaaagtgaagagacaactcaaagaatgggagaaaatatttgtgaactacccatctgacaagggattaatcaccagactatagaaggagcccaaacaactctataggaaaaaatctaatagtccaataaaaacatgggcaaaatatttgagtagtcatttctcaaaagaagacatgcaaatggcaaacaggccatttgtgttcaacatcattgatcatcagagaaacgcaaatcaaaactacaatgtgattatcacctcaccacagttaaaatggcttttatccaaaagacaggcaataagaaatgctggtgaggatgtggagaaaaaggagctctcatacaatgttggtgggaatgtaaattagtacaaacactatggagaacagtttccaggttcctcaaaaactaaaactagagctaccacacaatccagcaaccccgctcctaggtatatacgcaaaagaaaggaaatcagtgtatcaaagagatatctgcattaccatgtttattgcagcactagtcacaacagccaagatttggaagcaacctaagtgtccatcaacagatgaatggataaagaaaatgtggtacatatacacaatggagtactattcaggcataaaaaagaatgcaaccctttcgtttacgacaacatggatagaactggaggtcattatgttaagtgaagtaagccaggcacagaaaggcaaacattacatgttctcacttatttgtgggagctaaaaattaaaacaattgaactcatggagatagagagtaataggatggtttcctgaggctgggaagggtatcaggtgaggggggtattgttaatgagtacagaaagatacttagaaataataaataagacctagtatttgctaacacaacagggtgactatagtaaaaaataatgtaagtgttcattttaaagcaactgaaaaagtataattgtttgaaacaaaaagataaaagcttgaggtaatttaccccacttaccctgatgtgattattattcattgcaggcctatatcaaaatatctcatataacccataaacatatacacctactatgtacccacaaaaattaaaaattaaaataaaacaacatgtgaatttcaagcaatacaatattgtccaacaatcacaaacaagtttacgagggggtatttaattagccattcatcctcattttattctacttactgtatcagatccttttctgtgcagcatttgacacctttgcaattcacaagatattctatgtggttaaatttgtctcattttaaatagtacataatgatctgttattctcagtgacccttttcatttttttcttcatttatcaacatgacaaaattattttggcaaattggtatttatttctgttattttaggtcatgagatttctttgcaaagtaaagtaagcaaacacaaaatatttccttatattcagctggtttccagattcttctcctaacacagtcagaattgagattccctaaatctacgagtttgtggctgtaggtgaaataagtaaccaattaactgtctgtggcttctatgagtgataatgtagcatcttaagccactagtcatccccttcatctcacagcctcattttcttgccaagatattttcgggaggtcctcaggacttcagtggcaactcaggaactatatatttgggagtatgtctttgtttcccctcatctttccatgactaccttctttcctaatattagaggttgtccgtaaagttacttgaaggcggcatctcatcactgtcattgttttcagtgctttctacaagaattttaatatctgggccaagagtgttttcactcaggattcaccacaaggaaaccttaaggtgtgaagaaggtttcatgttcctgagagtcctctagaaactgagatgaggagaatggggattacccattctgtttcacattttgttatctgggcaccaaagcagtttttttttatggcaccaatatcactcaaaatccctcacaaaaacatgttaaaccccttcatgcatctctgtctcactgccatagtatctgatatttcactatgagtcttagcttggaaattaatattttagacaaactactatctggccttcttcatctcagttctttcgccaacccctgggatgaatactctgtcacacaacgcactccagaacttaagttaaaatgcacaggccctcacctgtaatcccaacactttgggaggccaaagtgggtggatcacttgaggttaggagttccaggccagcctggcaagcatggtgaaaccttgtctctactaaaaatacaagaattagccaggcgtggtggtgggcgcctgtagtcccagctactcggaagactgaggcgggagaattgcttgaacccgggaggcggaggttgcagtgaggcaagatccagtctgcactcaactgtactccagtctggacgacagagtgagactccatctcaaaaaaaccaaaaaaaagtgccatacaaataaactcatttaattcatttttggtagctccaccaactgctttacaagacatatttcagacttacttggataatagtaaaatgtttttctttactgtcatgctctcctcttgtgctcaattcatgcttaaaagcactttgtgattcgccttttttcctcaaagccaactttgtcagtctagaactctactatattggtatatggccttcatttaaaacattattagaactttatacatacaacatggccaaggagataataaaagagctaaaaatatagtaagtccagagaccagaaaggcttataggttcttagaagagttattgaaccctggtccgtaccagaatcatgggagtaggtaaggatttttcaaaggagtcaattcttattgaaagttcatagagggtaaactttatatgaaaatattttctccaatcccttccaaattcagcaccctcaaattcatgccctccctcacaacaccctagcttttatcatgcttttattccagatgcatatcaagaaaaaaggaagaatggacctgtaagaatgaccctctttcacgaaacaggtggtacagatgtcctcttaaaagcacagtatcaatagacaaggtgagcactagagttaagagaaaagtaaagaattccagctaagttataaaatcttaatgacaagaggagataactgaacattccaagaaaaaaggggatgtaggatgtaggactatgagtgcgtggtgtttggggtttataatactacttgataggaacaaaaaggctagaactaatagaccaaagtagatttgaaacgattactggccacggctgaatgactattacagtatatattatttccaaatgagtaatatcctctataaacctacacaaagagacagatactaatgtagaaatttaggaccagatagtaggaaccatagtatagcaattattctcaagacacaaaggtttaaagcaatggttctcagagtatggttctggtcccagcagcattagcatcattttggaatttgttagatacaaaaattatcaggctcttcccaagatctactgaattagaatccccagggtagggcccagcaatccatgtttcatctgcattaatcaccctttatgtaattctgatgcacattcaagtttgagagccacttatttagggacaacttataaattaatttgtacatatgaacaaacattgtttaattgtctaggttcaagattccacagggccaaaagagttatacaacaaaacccatgccctccagggtcataatacgtggttaagacacaaagcacaatgtacagatattttcaaaattcaaagcaacaataaaaaagatggcatagagcagtcaggttaagattaactgcaaatttaatagaactgaatattcccagtgcagttcctatgaaagaaaagattacttaccactggtggaataagggaagatagctagaaggaagtaatagttagaattgttaggagggtcagatggaaagagagaggggcattcttgaaaagctcggggcaagatgacttcaagggtgaattctaccaaacagtcaaagaggaaataatactaattcttctccaactcttccaaaaaatagaagggggaacacttccaaattcattttgtgagaccagcattactctgataccaaaaccaaagacatgacagaaaagaaaatcataggcctacagccctaatgaaatagatgcaaaatcctcaataaaatactagcacaatgaattcaacagcacattaaaaggaatatacaccatgaccaagtgagatttacccctgggatgcaaggatggttcaacatatgcgaattaatcaatgcgatacaccacattaacagaacaaaaaacaaaacaaaacaaaaaatcctcaagagatgcagaaaaaccatttgacgaatttcaacattctttcatgataagaaccctaaacaaaagaagtatacaaggaatttatgtcaatacaataaagaccatttatgaaaagccctcagctaacatcataatccatgaggaaaaactaaaagtttttcccctaaaatgcagcataaggtaaggatacccactctcaccacttctattcaacatagcactagaagttgtagccagataaattaaatgagaaaaagaaataaaagacatccaaatcagacaggcagaagtaaaattgtctctgttttcagacaacatgatcttatatatagaaaactctaaaaacaccataaaaatctgttagaactaataaatgaattcagcaaagttataggttataaaaatcaacatacaaaaatcagcagcaaaatctttacatcataacaaattatccaaaagaaattaacaaaagaatccaatttaccatagcataaaaaaatactgaggaataaacttaaccaaggagatgaaaaatctttacactgaaaactgtaaaatattgatgaaagaaattgaagaagacacaaataagtggaaaggtaccccacgttcattgattgaaagaattaatattgctaaaatgtctgtaccacccaaagcaatatacataacatagtccctatcaaaattcccattccatttttcacagaaatagaaaaaacaatcttaaaatttgaatgaaaccatgaaagaccctaaataggcaaagcaatcttgagaaaaaaaggacaaagttagaggcctcacacttcctgattttaaattgtactacaaagctatagtaatcaaaacatggtactgccataaaaacagacacatagggaacatgttccttaacattggtcttagtaatcttggtaatgattttttggatatgatcccccaaacacaggcaaaaatagcaaaaatagataagcaggactgtatctaaaaagcttctgcacagcaaaggaaacaatcaataaaatggaaaggcagtctacagaatgggagaaaatatttgcaaaccatatatctgttaagggatctatatccaaaatatataacggaattcatacaactaaatagcaaaaaaataaaaaataaaagtgggcaaaagactcgagtagacattttctcaaaggcgacatacggatagccaataggaatatgaagaggtactcaaaataaccaatcatcaggaaaatgcaaatgaaaaccgcagtgagtgaggcaaacgtgatagctgctacactatagaaagatctgtacacttaaaattacaaaactttgatgaaagaaacagatgtcaaagaagacacaaatatatgggaagatattatatgttcacggattagaagagttaattttgttagaatgtccagactccccaaagtggtctatagattcagtgcaattcctatcaaaattccaatgtcatttttcacagaaatagaaaaaaatccaaaattcctgtggagccacgtacatgatgcacatgtgcacgtgcacacacacacacatacacacaccccccaccaaatagccaaggcaatcttgggcaaaaagaaaactgctgaagccatgacactacctgacttcaaactatattacaaagatgtagtaattaacccatttaggcctgaggttgtaacttttggaatttttgcagtcagatcttggcgatgaacttaacagtaggatataaataactcccacatgcttagcgttccattaatggaacaccagggattgatgggctaaaagagcatggtacaggcataaaaacagacacatcaaccaatggaactgaatagggagcctaaaaagaaacccatgcatttacagtgaattgatttttgacaaagatgccaagaacaaacaatggaaaaggacagtctcttcagtaaagggttttgggaaaactggatatccacattcagaagaatgaaattagaccctatctcacagcatatacaaaaatccactcaaaatggactaaagactttagcataaacctgaaactataaaagtactaggaaaaaacgtaggagaaatgctgtatgacactggtctgggcaatgatttcttggatatgactccagaagtacaggcatcaaaagctaaaatagacaaatgggattgcgtcagactgaaaaacttctcacagcaaaggtaacaacagagtaaagaaacaaactatgaaatgatagaatatattttcaagccgtacatctgataagagattaatatccaaaatatttaagtaactcagagaaatcaatatcaagaaaataatcagattaaaaaatggtcaaagtacctgaacagtcatttctcaaaagaatacatacaaatggcagcacataaattaaaaaatgctcaacatcactaatgatcagggaaatgcaaattaaaaccacaatgaaatatcatttcatgtttgtccgaatacccattatcaaaaagatgaaaggtaacaagtgttggtgaaggatatggaagagagaacccttgcatactgttggtgagaatgtgaattagtaaagccacagtagaaaacagtatggaggtttctcagatatctaaaaagagaattggcatagaatccagaaatttcacttctgggtatatatccaaaggatttgaaatcagcatgttgaagacatatttgcacccgcatgattattgcagcactattcatgatagccaagttgtggagtcaacataagtgtccatcaacctataaatggataaagataaatgtgatatatatatatatatatatatatatatatatatatatatatatacacacacagtggaatactggaatactattcagccttaaaaaagagaaaaactgtgtcatttgcaacaacatggatgaatctaggggacattattctaaatgaaataagccatgcacagaaagacagatgttcagatagcacatgttctcacttatatgtgaaagctaagaaaaatcaaatgcacaggagcagaaagtaggatggtcattatcacagtctgtggagatacgggaatgaagagaacttagtcaaagggtatagtgtttcattagacaggaggaataaatgataaatacttgaagtgacggttatgttatttagcttgattcaatcattccacattatatacatgtatcatagcatcgatttttattccataaatatatacaattaaaatttgtcaataacaacaaataaataaaaatgaaaagaattctatgtaaaaaacagtgagatatcacctcgcacctgttagaacggctattataataaaaacaaaagataaatgttgtcgaggatgcggataaaagtgaatccttgtacactgttggtggaaatgtaaattgatgcagccattatggaaaccagtgtggaagttcctcaaaaagtttaaaatttatccagcagtcctgcttttggatatctatccaaaagaaattaaatcactatctcaaaaagctatctgcacttccgtgttcactgcagcattatttacagtagccaagatatggacagaacctaaatgtccatcaataggtgagtgaataaagaaatttggaggaatatatatattttatatatatactatgtttatttatttataaaaatatatattatatatatatacagtatatattttatatactgtatatttatatataatatgtattatatatactgtatatttatatataatatatattatatgtagtatatttatatattatatatatatagtatatttatatataatatatattatatacagtatatttgtatatattatatattatatacaatatataatatatagtatatttgtaaatcatatatattatatatagtatatttgtatattatatatattatatatagtatatttgtatattatatattatatatgtatatttatatataatatatatattctatatattatatatagtatactatatagaatatattctatatagtatatatagtatactatatataatatattctatatagtatatatagtatactatatataatatattctatatagtatatatagtatactatatataatatatatattatgtatagtatatttatacataatatatattagatatattgtatatttatacataatatatattagatatattgtatatttatacattatatatattagatatattgtatatttatacattatatatattagatatattgtatatttatacattatatattatatattgtatatttatacattatatatattatatattgtatatttatacattatatatataatacatattgtatatttatacattatatatataatacatattgtatatacataatatatattatacatattgtatatttatacataatatatattatacatattgtatatttacacataatatatgttatatatttatagacatatatttatagatatataaatatatatctataaatatataatatataaaaatatatatctataaatatataatatataaaaatatatatctataaatatataatatcgataatatatataatataaatatataatatcgataatatatataatatataaatatataatatcgataaaatatataatatataaatatataatagcgataaaattatataatgtatataatatatataattatatattaatatataattttatatattatatataattatatatattatatataaatatataatgtattaaaatatctatatataacaaggtagtagttgtatagtaaatatcaacactaactaaaaatagtttaagcaatattttgtttggttttgcttgctttgattttatttgttttgatatatatatagattacaactactaccttatgttatatatataatatgtattatatatattcctccaaatatatatatatataatacataaactttcttgtatgaaataaaaagaataaaaagattaaaaaatttttatgaaaatactgtgattaatattggcaccatttccttctggagtcacagtcaaaagtaaaagcactttattgaataaatttgataattaagaactgaagataagtagatttttatctttgtttctaattagatattccctggattaagaaaaatatcacttgacccagaaagaattttaacaaaaccataattcatgtgtagtcaaaaatgtcttagcttatacaggtttataaagatagcactgaaagcacttcaaagtataattacttgaatttttaaatgagtggatagaaatttattctatgtgcaatgaaagttttcagataaattttgctgcaaaagaactattttcatgtttttatttgatgctattgtttgtttcttggatcttcactgcaaaacacaaatatttagtcactaaattaaggctaataattttaattccgcttaacttaatgaatacaaatatttttagttttctcttttaaaaaggtaatgtcttgagacactttggtattgccagtggtaaatgagccgaaaataggtgcaaatgtgaatggaaacttgatgtatgacagagaatcactgtaaatcagcagggtatgcatgacctattcgttaaatgccaagggaagtgatggttatctatgtggaaaaaacgtaacagtagacagacatcgatttcatccatatacaaaaataaattccatattgatcatggtcgtacatgtgaaaggcaataaattaaaggataaatccttatgacctttgggtagggaggaatttattaaataagacataaaagcacaagccattaaagaaaatattgataatttcatatataaaatttaaggacttctctttattgaaaggaagaataaagagagaaaagactaggcatagtggaaaacgatatttgtaacactgattactgaaaaaactgtcatattcagagtatataaatactgtcagaaatcaacatgaaaaaggctacggtgagggggaaagatgagcaaattacatgattagtattttcatagaagaggaaattcaaatgaaatgccattgaatatatggaaatgtttagataaaattacacactaactagaatgactaaaaataatgacaacactaagtaaagatgcagacaacggggaatcattttggttcaattactttgtaaaataatttggcattacctagtaaatttgaaaatgtgcatacttgaggacccagtagttccattcctagatgtataacctacaaactcttgtacatattcaagaggtacacaaaagaatgctcataagattgctatttgaaatgacaaaaagactgaaaacaatacacatattaaaaatataataagtaatttgtagtgtacttatacaatggatattgttcagcagtgaaaaaagaatggaataaaggcccaggcatctgggtggattaatctcagtaacataccaatataccagtgagaaaaaaaaaagcttacagccgaatacacttgtgagattccataacttaaatttcaaaacaagtaaaacaacaaaaaaatcaaaacaaggaaaaccaaacaaaatattgctcaaactatttttagttagtgttgatatttagtttacaactactaccttatgttataaaactataaataaaagcaaggagatgtttaacaccaaattcaggatattgaatacctctgatgcaaagatggagattgggattgtcaagggacaacagatttgaaaaaactagtgtctgttgcttaagcaggatggtgtaagtagaaaggtgttgattttgcgaaattattttctgttcatattcgctaaactgtacatttattgtcacactattttgtatacaggatgtttttaaaaatacaaatatcctatttgcaaagtaaagaatgaaaatgaataggactgagaccagactgcaggcaagaacattggctgggctacaggctgctgctgccaggggagaaatcatcatagctggagtcaaataaagtgggaattggggaggttagggggagaggaaaaggatttaaagggactatctggagattaacagttaaaaaaaaaaaaaagtatttcacacaaacttagtgtataagtagtacttgtcatggtctctcttttctttttaaataaacttattaattgaagtataacatacatagagagcagtgaagcaaaagtgttcatcagtaagttttataaagtaaaaacacgtgtgtaaccgtactatgcagaacaagaaacagaccatgaacaacactccagaagccccctttgtcgccccttctgatcaccaccaccccttcctgcccaaagattaccatcctgactcctaacatcatggaatagtttcacttttttgggctttacgtaaacgaagtggtcaggtatgtattcttttgtgtctggcttctccaacaacattatgttgtgtatttcatgtattttctatgtatagcagtatatcattaatgtttatttctatataacatttcgttggttgatcctaccacaaatatttatacattttactgtggcagaacatttatgttgtttcttgttttgggttgttatgaagaaagctgcaattaacactcctgtgcatggatttttttgtacatatttcagttgaaaatatatatatgcttgtgttccacttgtgtaggtgctgacgaaagtgtcagttttacaaagtagttgagtccatttacaatcctaccaagagtttatggaattcctacttacttcatatcctcataatattttagattttcagtcttcttaaaaatttgtcattctattcagtatatggtgatatttcgttgtggttttaatttgcatttctctgatgattagcaactcagaacaccttcacacatattcgttgggtatttaaataccccttttcattcttgtttgaattcttggctattttgctattgggtggtatgtctttttctggccgatttaaagactaataaaattggcaatacttttagtggaatgttgaagagtaaattattaaattcagcaagacagaaaaaggagcagaagaggtacaactatgacttaattctgggccttactttggtcatctttggaagagtgttaatctgccagtataaaacagaattatttctgaaatcgaaaaccaaaatgactttctagactcacctgctgcaccagcattgtataaaattgtggcacattttctaaatcctctctggcaaatgcgagaaacttacctttaatttgtcatttgtgattcctcttttgtgtgggtatttactgtctgtgagcttttgaaaagtatagagagaaaaaggctgaggatgggaagaaaagagaggggtctcttttagcactcttttctgtgcatgattgctgatttgagaagtcatagcagccatggtctgggagattttcagccttagttcatgaaattgtctttctaaaatacaattcttctgtatagtgggaatattcctgtttcaaagagaacgtgaaggaccatctttcctcttccctagaaatattagtttgttcatgatataaaaatggacaagagtgtttatttctctcagaatatcatctgttcttccaacaagaagcactgtttaataatagacataatgtcagtcttcccattttataaagatactttttttcttatccttttacttaactagatatcctacatggtttttgagaaacttgcttgattttgccacattttacagaggccttacagaattccataaatgtatttcacagtcaaaagtttcaccagaactggaagttaacatggtttccatctttcatcagaattagagagagagagagagagagagagtgttagtgagtatgtgttttaattcttgttgtgtcatctaattatacttttccagtttaaaaaaaagttataaggtgtcaaaaattatgagggaggtgaggtgcaagaaaaggaataaatcaatcggtgaatgaatgaaaaaatgccatgagtgatttcatattaattcaaatgaagtaatttgataacaaaggcctttattatgcaatgataacagtgataatactgatgacaatattggtagatatctgctaatgacaggtatcttttccaccgtgttttctttggagcttcgtagttgctttggaaggatgttatttcgtatagaattctaaaagaataacaaattctttggaagtttcattgagtgaagtggacatgttgactattaatgatgatgatttttgacgtaaccttagagaagagaaaagaatgtttgaagggtgggaaatggtttcatctatttcgggagatagataggtttgacttgagctgtcatttatatgaatatgtgctataaagggcctgattttgatgctagtcgaaagcacctgacaagagtaattacctatcaccagtcctcttggacattgcatgtactttagttctagtgagtggagcaaatagaggggaaacagtatctctgcactgaaaaggttatattgtccagcataggaaaataaaaatctacaacctaacattgatgtaatttcagattttttttagttggtattcagcaactaaatttttgtaaattttggaactactaagtgccagggaattacactaggaatgggctctactctcaagaagaaatagaaatggacatacaaagaaggacattataacccaagtgatatatgtatcaatagtacttcatatctacaagttaatcactgaaaatgtgattaactttccaggacgaagttgattaaaaggaaagtcatctgtactagattttcaagtgtctttaacgttaccaggtgaaaaagggggagaaaaatattccagacaaaggaaacagtatttgcagaggtaccaagatatgaaaaagcttggcatgttagaaaaactacaagcatttagtgttcttagagggtgaagcgtaagggaggataaatggatacttaagtacagtgtataacctcttgctgaggcctgaaaaatccagtcaaagttggcttgaagaacattaagaggaagggctagtggccagccatagtaagtcttttcttccctttctaccccatttgctttccaatgcagttgtacttatgagtcaagattgaatgttgtcccctaatgaaatgtaatgacaaacagtttgaacgtgttaatagagtatggataggcataatgcatttgagatcatgaggaaacatcagtaaagaatattcagtgtttttttttgttgttgttgttgttccaagtgttttctgacatattcaaaaagaaaaagagtaaaaattatttgaaaagcaagttggaaaaaagaaaactctgctctgggcctgctacagtgagagatccatctatacagattcatcgttcttaaggagatagaaggatagcaatgactggcataagcaaattttccatacttcaaactctcagaggatgagtcacaccaagtgtctatcgcaccatgtaccccctggccttttttcaaccctgctgctgggtaccaggggaagggcaggatgtgaaagctgatggaatgaaggcacacaaagcaaggtagtatgcctcttgcaggaacttttcttcactaaggccaacaggatctgaagcgataaggccctaactggaataataggagtaagcatgtgatgagaaacatttgtcactaaaagcagcaaactttcaagacaagctctgatgcttcagatcagctagcagacaccagtgtttctcttcgtatgtagaagacaaagtatgattaaaacgtgcacttgacggataagctacttcactaggtttttacaaagattgtatgagataatatatgtaaaatccttaacacaatgcctggcacaagggaaatgctctgcatagatagtaaatatcatcttattcttcatctcaccattaatttttgtttttattttgagaattgaggctcaaattaatacatactattaacaggtacagaggtctttctgttttgataaatatttttatattctaatgatgttaatacataaagtttaagtagtaatttagttaagtaatctatgcattaatcttgaagtcatagttaattgaaatatttgtatatcccataagtacaaagtaaagatgtagtggcagtgtacagtatcaagatcagtaacagtagtggagatggcaattctatgagggagggaaatattgataaatctaaaaacagaacctatagagataactccccactatgtctgtgggagtgccaaagaagagaatgtgatagatgtcttagaggcagaattgacaggatttgatgacaaaatttaaataaattttggaaaaggaggcaatcaagatgaatcctagcttgctgctctttagtgaactgagaaaacaaaggatgaagatcacttggaagcctcttgtgaatggaggtcctggtagagggcttggaattgggtgcagatctcagaaacaaatgtcaggactggacacacaggcttggggtcatttgcaagagattatagtccttgacacactatgttttagtgttttattttaaaggacacaaaaatctgaataaaatgtggatttataccttttttttttttttttaaatcacatttacaataaactttaatggtgaatcaatgcaacccaaagccaaggtagccctctccatttggtgataaaatatttggatgagaacaaaataaaaataaccatcatttctagcattgaccaagtaaaatcaaatatagtagatggtacttcttttaaaagaatttaaaaatctagcagaacgtgacagagtattttgtgtaaggtattcttcccctcagtatttatttattaaaattataattttcaacctatctttccttgaggaatatttgatgttaaggaacagaaacctattcagagaaactcagattaaaactgagtatactgcaaggatacagggattctccggaaatctgattactggagtatagcatgccttcacagattagaatccaattatgtaatatgttttagctttaggtttcaataaagccatatccaccaaagcgttcttgttaagggatgcattttaaattaaataaatgttaatatatgtggtactacaatgccgtggggactataccattagcaaatgtgaaatatctcatcacctgattaagaatgcacagtgttttagaagtcctccatagcagccatcttatttagtcagattgcccattaatgctttgttaagattatagtcatcttgaattctcacaacacttatgaccttccaaggacagactatgtttagtcactgggttgtattaactgctattaacatcagtgcttatctgagatcttcatcagttacagctgaaatgtgtgagatgtacctgcacacagatgtgttggactaatggccagaaggcagcaaaccctaccattttccttgttatttaaatatttttaattctgtctctgatggcttcccctgtcacctcatgagtaagtagggctaatactggctgcagcaaaatcacactctccatttatcatactaattgcagtttaatgaggagaggcccgaggctggaagacttgtctacgtagaatactattggagtggagtttattatggttattagtacagcctgcgataattaaattgctttactagataggtactgtatttatcataaagattcactatagcaaaacttttgatgatattcaaagagcagttttgaaagtcaagttctctgacgttttctttaggagaaattctagtttggatcccattttccaatatttctcctcagagcaggactggctacatcatctgtgaagcccagttcaaaatggaactgcagggcctcttgttgaacaagcacaaaggaagtgttaaaatataaagctttcttctttcttctacgtatcctctttgctattatgcataatgcatacttcatggtcccattggactttacttgtaaaacacaagttcaaagataaaatcattaaacatttcaaaataatgacagcatgcagctcatctgagtgtggtatcctgtgtgagtgcacagactgcacttctgtgaagctgaaagaaagaagtgtaaatggcaaaccatttttacagagttgagactgagctaatcttttgctagaccttgtcatgcaatatagtatgaaggaagcccagtcaaatttgggaaacagacaactggagctgaggttggggataaccttgagggcaaccaggacaatgaaaacgaaccggcaataaggactagtaacttccgtctcagtcaggaagctgcctgtttcctgcaaaggcaggaagtcattccaagatgtagtcacattaaagtccttaggagggaaaaaaagagctaagataaaagaatgagaagtagtttaaattaaccaataattaaaggtagctactgtattaacacaaacatgctagcatattccaactgaataataaaattttccagattttctgttttttcccttcatgcacattatttaaatattgcagaatgcacttgaataaaaatattctaaactgtattgaagaaggtggagtggtttgtgttgtggctaaactgggtttttctttgtttagtttgatgactaatctctttcctaatcattggacaaactcaataggacctagtacattatcccacacataaatgaagtcggtaaatgtttatggaaataattatatataatttactctctacaatgagtgactagtaggcctcttaggaatatgttcccaggtactgaacactcattgaaatcagagcactaaaagtactctacttccactatgaagtggaaggcagatattgtccaaatatggaacaccagtaataaataagcaaacaatggctcagctgagagactattctgctctaatttcctgatgtaagttgttatttcactggtgagtaacatcttcttgtcacaacatcatttataataataataatgatgatcacacagaatcacctgtgaatgtcctagtccccatagtttaatatagaacatcactcaaatttaagtgaggtctttgttaagttctgtaaattgagcttataaagacaaacactatttggaatattttttgatggcttgatggagaaagacatctatttattcactcaacagttatttatcaagtgcctgaacagtactagaccctaagaatataacagcaaataagacagggatggtctctctcttcatggagtttatagactggtggacttctagaataatgctcaacactattaatttccatcaggtccacatgcctgtgccttacaaataatcatgcatttgaagatagaattgaactgaaactaggcttagagcaactggacatattctaagccaatttccaaaagttaattaatttaagtggcttccccattagttcaaagaaaaagaagataataggagggaaaaatactgataattttctaagttggactaagtttggtaagtataaaaaatgaagtgtagttaatagagtgcaaagcagaagatttcctcttaactcacagttattatacatcatcattagagaggggacttgctggctccctgtgctagattaatagcccaggccttcgtctctttgaccccagctgaagtaaaagcaccaggcaacagaagcagaacatggagtaaaatctagtatttcatctgggcagggaaattaaaaagaggaagcacttaaattgtagaggagaatgttaaagggagggatgttgctcctttctttcccttgatagttctaccctttgagaaccagctggcagctcctggatcactaagcttagtcattcctcttttcaattataggaacatcctattaacagggaaatggagtcgggagagttattttagtgagagagaagaaaaagagaaggggaatatttttcacatggagaaaaagacctccaccaggaaacagggagtccaatgcaaggtaacacttccctgccccgctgttttcattttaaacttgatgaaaggaaacatttcaaggggtttaaaaaataatagagagcaggctttggaatatataactgttgtcaggagaatttatattctattgcaggaaatagaaataaatggagatatttgagattatatgagtaaatatttgaggtgtttgtttaaagaatacacatgccttagtactgttgtcagagagaaaaagttggattgaatgtaccatgggttttttatgattctctcagcatctcatccataatttatggttttagtatatgtacaagaaatgtaaatgcatctgaaattattgtaactctcatatagccatgagatattgaacactgtgatccataatttgtcagacctctccacttccgtggatccattattttatcaaaatactcattaaaataaatgttgcttctgactctattatcatcatgtatcaaactaaaaaaggaaacaaaattcttaattatgttttcaaagttaatcagagggtgtgatataataaaaatcatatatttggtctttgtccctgattccttgacaggggattcctaactgcttggaattttctgggtgataggagcatcttttgtttcagagatgccattcttggtgggccatagatagcttcaggatgggggctggttgccagaaaggccaaagcatgatcagaaggttggaactttcagccttagcctccaacatttgccaatggccagtcaatcatgcctacataatgaaacctttataaaacccctaaagaatggggttcggagagcttcttgattggcaaacacatggaggtgctgagaaggtagttcacctggaaagggcatggaagctcctccaccccttatactttgccatatacatatctttcatttggctgttcctgagttgtatcttttataataagccagtaacagtaggtaaagtaccttcctgagttctgtgagttgttctagcaaattatcaaacattggaggggatcatgggaatccccagtttatagctgatgggtcagaagtgcagatggcaacctggtacttgtgacttgcatctgaagtgggggcagtcttgggactgagccctcaacctgtagggcctgtgctaactctaggtagtttgtgccaaaattgagttgaattctaggacatgcagttggtgtctgaattgttgcataactggttgttggtgtgaaaaaaaccccacacatttggtatcagaagtgctgtgagtaaaaacccttcagatggctattcttgaagttcttctccccgtgataaaatataaatcactatcacagtaataataatcttaatgtgttagtataactgattttagtaatttaccacatttcttactatgggtgaaccaggtttaaaaattaattgtggtaacttgtcctggaccactggattttctattctcttttgagaaatctttaaagacagaaaattttacaatatagaaagtagaggaagtttttaatgtcatgataacataaagctacttggattttcatttcatacacttccaaaatagtatcttgagagattctcttttttgattgcacatctaatatcagaaattcattatttttatgcatataggtaatatgacgattctttaaatgtatcttagaatgggttttaggttccatggataaagatctcagaaatgctttgtaatcttggtttcgtcatggttctacgagtgtgaattttagttggttcacctctttgaaatgtccatccctcttctcaaaatagctagtcataaacctgactcatctcatggctttattttctaaagagaaagaaaaacttacaagcagtttgaaaatgtgatgtcaaatactcaataggattaaagttattaataaagcaaactataatatcactgtttgtttcttcatgtaatagaagtattcccaaagaactgtgtttattttttaattgagttacattgtaattggactagaaaattttgaaatgtgattcttttaattggatggcttttaattttaaattcttacgagtcaaaaattacttagctcaggtgtggtgtgtgtgtatgtgtgcatctgtgtgggctgggtcagaataggactggtagagaccctatccctaaaagtttatggcccccatatgctgataaataacatcaaataaaaacagtaccaaatgatagaaaactctgatttttctgtgatgatgagtattctaatgcttgctttgaaatataattcataacttttaaataaatattttcataaggtcttgctttcctgatgccctaagcacatagtatttcatgcatgtaggtatccaaggctgttcaattttaataacgctaaccggatattgacaaacctctgcctcaactttttgagcaaagcttcagagtacatcttcccagctacttgtttttctaagtgtttgtttttaacctaatttattttcttagtctcagtgggaaggagaaaatttcagtgaaatatgtgctcggtttcttgtttggtccctaatgaaatttgtacttgaaaaagcttagtcttttggaaaattttggaattaaaaagaaatatttgactccagttatttttaaaaccaaaataaaatatctctagtgaggaagtccaaatcatagagttgaagaacattccaataataatatccaaggataaattaaagtgcattgttttctctgtaattattttttggataatttcatcgagcctagtatagggagaagatgatgtgtttctccattaaatctgttctagctgcacgttaatgcctggtgtgttataggcttgcagttcctttctggggaggtttatgcacagtttccatctgacatggtggtgagcagaggctaatgaaactaaactctatgcacactaacatgactgcatttgtttggtttactcttctgttagttgttttctctcttccttgcattttaccttctaaggcaactaagggccaattttgagagttgcttgtgatggttctttagcctagggctattaaaaatatgccccctggactggagctgctgtagaaaagaacaggagaaaagatgatgttgacagccacagattaaagccaaagaccagaaatgaaactatattcaagaacatttgagggattacagcaagtcaggaatgaaagtgggagcatagactagggaggattcttggaacggacacagaaacaataatcctatgagggcagcaacaaagtcaagaaagccacagtatccatatataattgaaggagaagaagcagggagacaaagggactttaaaaactcaggttaaaaccaagatttaagatgagcctgtaagagttcaggctgtgagacaacagcaggaagaggaaaataggcagcagaggttgagagagggagagagggacagacagagggagagagaggttgaaagaagagagaaagagaggtctagtggtatgttatctaaggtaaaactaggaacaatttgcactgtggcaatgtgacagttctagaaaatatttgttcctttgtattgctatttctgttattatatttctagaataagctgagttcagacacaagagatcaagatgatagtcaagggactagcacttctttgcttcatgattatggtgatacctgggtctcagtttgtctgtttgtataacgggtttgaaggagattgagaccccgtggcgtatgtgtgtgcttgtgtgtgtgtggtggagagagagagaaagagcactgaaagttgtaaatacaatttgcccttcatctatgtcaaacatgaagacttcacaatattagaaaggacacagagttaagaaagttttacagtataaaagcagagatatgagaccatatagaaagaaagatattcgtataccaaagagaatgagaagcagtacttattaaggggaacagtaaatttagctctgagcttcctggtagcataaaaaagagcaaaacaagatgagttagagttttctctaccagttaaaaataaatgtacaagttcctttcacttcattttaatttattatacagagcaaggatcagcaacctggggtctaatgggcccatgggccaaacccatcccatacctggttctgtaaataaagttgtattggaacacagccatgtccatttgattacttcttatctatggccaactttttgctacagtggtggagttgagtagttgggacagaaactgtatggcccacgaagcctaaaatattatagtttgccagcctctgatatagaagattctaatcttctatatcaatgattgtaacaggcatttcaatcttctctcaaaagatttcttttattaatatcataggtataaagatccaaggcaacaatttaactcatgatttagtgaaggcattgtgtcggtgtgcgtgtgtgtgtttgcatgtatgtgagagagagacagagagagagagagagagagagactgttgttgtggaggggcttaggaactgtagaatactctagaatatctgctctgtggttgtagagaatatttgctattctgagacactgagtgccaacttgttcatattggtaaaagttgcctaatttattcagatatctattcctctcttccatgtgcttcatgggaaacctccccatccttccacctgtaccccctcaccacaccagtactccaaggagtaggccctcaaatcagtcagcatattctatccttctggtcataatacttgatccagggttagggcacaggacccaattcaacacaagaagtatgaggagagatttttctggaagctacatgagatatatttattttatgccagacacaaacaagaaagcgtggaattcctagaagccataggctgacattgtgtgtggataaggaaaactaaatttaggaggaagtagatacaggagaaggcagaaaaaagtaaagtaattgaatgttttaggtcaggccccatctgaaacttactccatgtctgatcttattgatatcatgaagtttaaaagctcttattgtgtaagccactttgaaaagttaattttgaatgagaaaaatttgatgatgctagtcatctttcaatacatgcggagaaatgagaatttgaagaaaggtaagttgtgaaatatcagaaacatcttttgaacttttagttaagtcgaagtctactcatagtagaaatctctgacaagtgctcagaaggtcacatatcatggtctgtactcatgcactatgcttgcttggtaaataggtggtaaaggtgacattctcttagaaaaactcaatgtattctccctagagagccatttcgctttctagaaagaagggtttcaaggagtattgaaaacgaccaaaaagaaaagaactttatcagagccttcattgaataataatgatttgttcttgtttagtgcaaatgagttgcagcagggagctctgggaaaatgtggttgtcatggtaactgataacactttttcctactggaagtcaaaatagccaaagacactacacagggccatgtttccttacagatttttcccaagtaaaggaaataagaaaatgggaaataaaaggaagatcttgcatttggttgacctctgttcttcccacaaagataaacagaattaaaggaaatgctgttttgcataattggagccagataggcgaaagtggcatctctgtcttatgatacaatcatcccagtacaggtggagagatgattattttataaccaaagtttgagaaagtactgcccagaaaacatttcagaataagttaattaaggacaacatttaacatttggcatgctgaggaattgtttttctagtgggtttgctgtgggctgaaacctgaaaaacaatatttaattactctttgaaaggcatgcaagctttctgaattcattttcttacctgtgaaatgaacagtttggacgatatttcttgttttcaaatatttctctcagtaaaagcctgcaagaaaaccaaacctataaacagataaaattgcagtctcagatgcaatcttagcaggaagctcagaaacagctgctgggcttcccttctctctgaaatagtccttaagacattttatagataataactggcagacatatatgctctaaagcttctgccttttaaataggcgcacatgaaatgtcttaattgctctaaacagagcaattttccacctggtagcagctttccaaatggctcagcaaggaggaaggagataccacctaaatcagagtaacctaccctatggttgaataggttaatgtaatgtttgacatagacaacactgccttctggtttctggaagaaaataaccaaattatcgagactgtgctttacagatttgtccctatgaagtaaaagtcccatgaaaacctatacatctacaccacaatctcatatgattcttgtgacgttaacaaaggcaaaattagatgctagatataaatgctctttgaaaagctgaagagacattccaaatatacgctggtgtgtgtaatataacatattggcttataaataagactacaaatctagccagtgggatttataaccaaacctaagatcctgctgcaaattgtgtgaaattaaattacatttggagaaattttaatatattatttaaatatgaattctagttagttcaaactgaactaacacttttgaaaatgaaatacagaactaaatataagtaacaggcatggattgatttacaacaggtataaacagggactcttaagaaagccagccatatggttaccctagttagaatacctttaatgatggtagatcaactaacctgaatcctataccagcatgatatgaccctaatcccttctaaataccctcctttggtcttcagttttaaaagataaatattttagaatgttgattcaaaatatttttttttatactttatgttctgagatacatgtgcagaacatgcaggtttgttacataggtatatatgtgccatggtggtttgctgcacccatcaacccatcatctacattgggtatttctcctgatgctatccctccccttgccccttaccccctgataggccccagtgtgtgatgttcccctccctatgtccatgtgttctcattgttcaactcccacttatgaatgagaacaaaatattctttagttatttgaaaacatttcctagatactcatgggattctgagtatttgcgagctatagaatgagtcaattaccttatgcccagttggtagctcactaaatcttactcatctaacagcaactcactgatctattatatcatgaatacattgtctgtctgtcttcgagatgttgataatctactctccattgtaggtcttgtcttcagtaaaatcttaaatttataaaagttttaattcataccttttcatgtatctcttagcttctcaaaagttttcttaatcttgtggttatgtttggcttagaaagctaactataagggttgatttgtgttcacttcattgattgcattgtcatcattttctagcgtaagtctttatgataatagaatatttttaaaaggactctcactttaaaataccttatgaaaacatttcatactgcttgtgtgaaaaattcacctctgtgttctctctctccaccaaccatcacccccaccagtcttaacagatgaacaaattgccaattatatagtaatgtcagatgacaaggagtcgtggcaaacactacatcagtggttcttcactttatctgcatattagaatttgggttgggggggcttttaaaattctgatgtgcaggccacatttcagactactgtatcagaagccctgtgggtggggcccagtaatcagttctttttcaaatgtccaagtgattccaataagcaagcaaggttgagaaccacttactctaactattccataatacgagctaacccttaggaaaaatatagctgttttagaggcactgttgtgaaaggagagtgtgtatatatatgtgggcatgtgtgtgtgtctgtgtgtttggagcatttgacagtaataaggagttttgagggaaaagaagctgtgtgattaaaaaaaggatagcgttaatgacacttgccacatcaagatagatacacccaagaaaataaatgtattattgtaaaatatattttatctagaaagaaagtttgaaaaccctcaagaaaatatcgaaagaattaaagtcagtccctaaaaaccataataacattctcttgtgcttccttttagtcttatatctaggcattggatatttgttcacgtgggctataatctagtttaattgcttttagtttactgtcattgaactctggaggagattttactataagaataccttctgtccatttccataatgtagtaggattattgtggccccatttcacacctttctatagttgtaccttttggtagtgcctatccaccctgactttaggcttggcatatgacttaatttgtttaatggaacagtagcaaacttgtcagctgaccaaagacacaaagatcagttgagcctggatcagatcagcagaaccacccagtcaacccatagattcccgagaaataataaatttttttttcaaagccattgtgctgtttttatttatttttattgtatagatttaaggtatataacaagatgttttgatatacatatgagtcttgagatgatttgttatgtagcattagtgtggcaatagatgactgattaaaaaaaaaaggttatgcctataagagtgtgtagttttaagatgtgattatgattgagtgaccaataccttcaacagactacatgttttcttaggtctgggtggcagaggtatagaatttcctcatgtctcttgcaataaagttatagttgtgactcccatgatagttgtcagtcccgtgtacctacctgttcccaaactaagtctttctaggcttgtgatgctatttttatttgcctcttgtgaacagccagcgaaggagctgtacaagttcttacaagccacgtaagggacttaaaagtccctcagtctcttctattctaagtattcctaatagttcctttgtaatcatcctactcatcccataatgtgtactggaaaaacatgctcaaaatccaatatctccaagacaaaaggaaacatttcctaagagaacaggaatatggggtatatacacatattttagtgatctccttcctttagaatttctttctgaaattttcaaataatttatagttatcttcttagtatgggagttctattttggtttggaattaatcatgttctctagaccctcctgaagttccctcttccctagtagccatgaatgtaaactgacaatattcaaagtcaatatgtttctcttctgcagtgccttctgtgtccttaacacttgttattaactttttataactcacagtcccgtggttaagtctaccagggttcatgtaccaaaacattcccctatgtgatgagtttatttcggtaattccttaagaaactggtttattcttcaattttttttttgcttttagaagagcatagatcttttattttctgagtcttgttttctgttgccattacacattcattcattattttattcatttattcaatgaatatttattgagttttggctaagtaccaggcattgtattaggtacagtgggaaaatatgagcccagcctaaatgttgtcatttttgtagttaatctctgctatctaacatgggtacttataaacctattttcctaatatttaaaaatattgtcagcatgtgtctaaagttgagagtcttttaatcatttttgcctggagtatcatgagccctttcaattggctttgtgcaattttactcttaatgatattttcttaatcatgaatttgattattgcttgtattctagttccctgttttcctgaaaaaagactttcattcttaaatttaactcctcatactctattctatatattgtaaactagtttaaattcttattcttttttctctgccttctgtaagaatttcccaaatgtgacctgcactccactaatttgatactatttagagtgaattttgctctttactgcctccaatgggatttaattctgcatggtttttaatttcaattgtaatcttttttatatcattctcctttatgtatagttctactgtctttttttgcctgtactcttatttcattaagaaggtatcttctgatcttttaaggatttgagctttgcccttcctgagtttttcagatgctatacctttctctgtttttaatagataccgtgctgttgtgtttttctgttttgctcgtcttcacacaagtcaaggaatatcgtgaactgatgtttgtgattggtaagatacgtgagtgcctttggcctcactgtttagctaatccctttctcataacaatagctggaagactggttggtgtctacaaaccaattctctgcaattatcatactattttgtaacacaggattattgaactaatctgaaatagtctcttatcctcattatttggaggaattaagagataatttaaaaaatactacaattccctttgtgcactgcctttggacctttaatttatcaatttctgcctgtggtgttttatatgtgagtagcttacattttagaactcagtatactccaggaagcttcctatccactttctgaaaatttcagtctcaaattggtggacgtggtaggggtagaatgacgccccatcaagtagaaggctaaatgcccaactctctggttagtataagctttgagttcctgaataaaggattgagaggaacagagtcttccaacagacttgtaagggagcttagcacggtggaccagcaacaatgtttttaaatctctttccatcagccttgttttagttgaaattcctctcacattctgaaaacagattgacattaaggctagttttcagtgcttggagttgtcttttttcatatcatcaaagctgttttcactgcaggttaagagaagtttcaacagaggctgctagccagactctattttaaactaaaagccctactgtgttgaaggtatggaataaggtaaagggacagagatagaagctaaacttttcagagtatttcttactttatagatttgactttgtaactatagcaatgttttatataatcagaccacaaattaaacttttcaaatctcttctttttctgccaatgtagtccttccacctccttgtccatggttgtgcatcctttgcttatgctcatcacacagaagtgccccttggtgtgctcacttcaaagatatccgaagtcatttctcccaatgcccaggcctattgtcacttaatatatgatctccttcctttctggattattccccaggctgacacaccttatcctttcttctctatacctcatccgtcctcagagaggatggaaggtaagcgagatggccgagcagaagagacaaaggtgaagagctaccttaatgttgcttctgtgtgttaagctgtgaggagtttcatggccccagctgaagatgatagaagctttgggggtttatataactttgaaaaatgatgaatcatatatctttatgtttttaaaggacatttttatgaagaagcatttttaactcaaatgctctaagtttcaaatcaatggtaaatccatactatacaggcgttcttaaactataatacatttgttctaagcatgaaaatgaagcaatatttttaaacctgatttatattctgcacgatactggggtctgtgacgaacacgggagaagggttcctgttctgtgcccctaaggataagaagcactagttgagaagataatgttgcacttcaagcaacaagatagcatgattaaggcctaaaatatatggcagagactcagtgtattataagaataatgagatccatgagggtattaaaacattagatcaattagatattaaaagttcagtataatttagtgcagcagagtgaatgaatgaatgcagcagaatgatcctgagaatagaagaaaggaatctaccttttatttattcctttgacaacctctccaacctgacttttcaagcgctggccacaattataaataggaaaccatgtctgttgagacttctcaagggttacataagagtttatttctgtgagcagctttaggttcacaaaaaacatgagtggaaagtacagagttcccacacatccactcaccctttcctcaacagttttcctcgttattatcatcttgcattagtatggtacttttgttacaattgatgagccaatagtgatgcattattatttactaaagtccatagtttacattagagttcactctttgtgctctacattctatcagctttgagaaatatataatgacatgtgtcctgttacagtttcataccgaatagattttctgccctataattcccccatactccacctagtcatccctccctccccactcaattgcctggcaaagactgatctttttactgtctctatcatttttccttttccagaatttcatgtagttggaataatatagtatgtggccttttcagagtggcttctttcacttagcaacatgtatttacgtttcctccatgcctttttgtggcttcaaagctcatttgttaaatcgttgaataatattccattgtatggatctaccacagtttgattattcgttcaccaattgaaggatatcgtggttgtttccaaattttggcaattatgaataaagctgtaaacatttgtgtgcaggcttttgtgtggacataagttttcacctcatttgggtatattccaaggagggcagttgctgaattgtatgttaagagaatatttagttttgtaagaaactcccaagctgtcttctagagtggctgtactttttcgtgaaatgtcaattcaaatattttgatcatttcaagtgggctgtttatatttttattgaatttgaagtgttcttctttattctggataaaggtcctatatcatatatatgatttgaaaatattttctcccaatctatgatgaggcttgccattctctaaatagagatatcttttaaagtacaaaaggtttttattttgatgaagtctaatttgtcaatttgttcttttatgaatagtgctttgaagtcatatcacaaacgctgcctaaaccaaggtcatgaatattttctcctatgttttcttccagaagttttatagtttcagcttttacatttaggtctgttatctatttcattactttttaaatgtatgtggttggttaagagccaaagttcctcctcctcctcttcttttattattattattattaagtttgttgaagagactatccttttcctgttgatatatcttagctgttttgtcaaaaatcggttgatcataaatgcagggatttatttctggtttttaaattcttttccactgatctacatgtctatccttgggccagtgccgtactgtctggattattgtggcttcatgagtgtttgaaattgggtagtacgtattctctaactttattatttttcaatgcttttgtggtgttctaaatcatttgcatttccatataaattttcaaattacactttcagttactgtaggaaagcctgttggaattttgatatggactatattaaatctttagatacatatggggtttattaccatcttaacaatcttaaatcttttgatttatgaaaatgggatgtctttctacttaattagatattaatttatttattgtttatatttttcagtgtacaagtcttgcacttcttttgttaaatttactcccgagtattttattcttcttgatgctattaaaatgaaatcattttcttaatttcattttcaaattattttttgttagtatataggaatacaattgatttttgtatattcatcttgtatccagaaacattgctgaattttttcattagctctaataggtttttttaaaaaaaattcttaggatttttatatataaaatcatgatatctgcaattagacataaattgtatttcttttgcttccccatttgctctgctaaaacttccagtactatgttgaatagaaatggcaaaagtagacatccttgtcttgttcctgatctgaggaagaacaggaagttcccgtctattccttgatttttgagtgttcttaacatgattgagtgttgtattttgttaaattcctgtatcttttcagatgagtatgtgtttttgtcctttattaatatgatattatattgacttaatttcttatgtcaaattaccctttcattcttttaataaatttcaattttttatggtgtataatccttttctatgttgctggatttgatttgttaatttttttaaagaatattttttgtgtctacgttaatgagggatactggtctgtaggtttctttataatgtctgtctagtttttatattagagtaatactagcctcatagaaggctttggaaaatgtgttccctcctccagtatttactgaaaaagtttgtaaaaattttttatatttttaaaaaatttgataaaattcaccagtgtaaccatttgaacctgactttttttttctttatttcctctaaaaacaaaaacaaaaacgtgatacatgtgcagaatgtgcaagtttgttatataggtctacttgtgccatagtggtttgctgcacctattgacccgtcctctaggttcctcccctcacccccaccctgcaacaggccctggtatgtgttgttcccctctctgtgtccatgtgttctcaatgttcaactcccacttatgagtgagaacatggggtgtttggttttctgctcttgtgttagtttgctgaggatgatggcttccagcttcatccatgtccctgcaaaggacatgatctcattcctttttatggctgcatagtattccatggtgtatgtatgccacattttctttatccagtctatcattgatgggcatttgatttggttccatgaacctgacattttctttgtgggacttgacgttttttttaaacagctttattttgctacaataaacagtacatatttaagtccgacaacttaatgagttttgtcacatgtatacaccaataaaaccatcaccataataaaaaaaataaacacgtacatcacttccgaactttttctaatgcctcccttttgccccttcctcacctcaggtccctccgaaaacactgatatactctgtcactatagattagtttctaatttcttgaatttcatatacattgagtaatacattatgtactcttttttttaattatactttaagttcttggatacatgtgcagaacatgcaggttcgttatataggtatacacgtgccctggtggtttgctacacccatcaacccgtcatctacattaggtatttctcctaatgctatccctccccagccccctactgccacaacaggcccagtgcgtgatgttctcctacctgtgtccatgtgttctcataggtcaactcccacttgtgagtgagaacatgtggtgtttggttttctgttcctgtgttagtttgctgagaatgatggtttccagcttcatccatgtccctgcaaaggacatgaactcatccttttttatgactgcagagtattccatggtgtatatgtgccacattttctttatccagtctatcatcgaagggcatttgggttggttccaagtctttgctattgtgaacagtgctgcaataaacatgcatgtgcatgtgtctttatagtagaatggtttataatctttggggtatatacccagtaattggattgctagatcaaatggcatttcgggttctagatccttgaggaatcgccacactgtcttccacaatggttgaactaatttacactcccaccaacagtgtaaaagcgttcctgtttctccacatcctctccagcatctgttgtttcccgactttttaacgatttccattctaactggcgtgagatggtatctcattgtggttttgatttgcatttctctaatgaccagtgatgatgagctttttttcatatgtttgttggccacataaatgtcttcttttgagaagtgtctgttcgtatccttcgcccactttttgatggggtcgtttgtttttttctagtaaatttgtttaagttccttgttgattctggatattagttctttgtcagatggatagatttgaaaaattttctcccattctgtaggttgcctgttcactctgatgatagtttcttttgctgcactgaagctctttagtttaattagatcccatttgtcaattttggcttttgttgccattgcttttagtgttttagtcatgaagtctttgcccatgcctgtgtcctaggttttactagggattttatgtccaatggtattacctaggttttcttctagggtttttatggttttaggtcttaggtttaagtctttaatccgtcttgagttaatttttgtataaggtgtaaggaaggcatctagtttcagttttctgcatgtggctagccagttttcccaacaccatttattaaatagggaatcctttccccattgcttgtttttgtcaggtttgtcaaagatcagatggttgtagatgtgtggcattacttctgaggcctctgttcttttccattggtcaatgtatctgttttagtaccagtaccatgctgttttgtttactgtagccttgtagtatagtttgaagtcaggcagcatgatgcctccagcttgttcttcttgcttaagattgtctttgctatgtgggcccttttttggttccatatgaactttaaagtagttttttctaattttgtgaagaaagtcaatggtagcttggtggggatagcattgaatctatgtggccattttcatgataatgattcttcctatccatgagcatggaatgtttttccatttgtttgtgtcctctcttatttccttgagtagtggtttgtagttctccttgaagagggcctccacatcccttgtaagttggattcctaggtattttcttctctttgtagcaattgtgaatgagaattcactcatgatttagctctctgtttgtctattattggtgtataggaatggttgtgatttttgcacattgattttgtgtcctgagactttgctgaagttgcgtatatgtttaaggagattttgggctgaggcgatggggttttctaaatatacaatcatgtcacagcaaacagggacaatttgacttcctctcttcctatttgaatacctttatttctttctcttgcctgattgccctggccagaacttccaatactatgttgaataggcgtggtgagagagggcatccttgtcttgtgctgattttcaaagggaatgcttccagcttttgcctgtgcagtatgatattggctgtgggtttgtcataaatagctcttattattgtgagatactttccatcaatacctagttttttgagagtttttagcatgaaggggtgttgaattttattgaaggccttttctgcatctgttgagataatcatgtgttttttgtcattggttctgtttatatgatggattacgtttattgatttgcatatgttgaaccagccttgcatcccagggatgaagccgactcgatcgtggtggataagctttttgatgtgctgctggattcggtttgccagtattttattgttgattttcgcatctatgttcatcagggatattggcctgaacattttttgttgttgttatgtctctgccaggttttggtatcaggatgatgctggcctcataaaatgagttagggcagattctgtctttttctgttgatcggaatagtttcagaaggaagggtaccagctcctctttgtacctctggtagaattcggctgtgaatccgtctggtcctgggctttttttggttggtagtctattaattgctgcctcaatttcagaacttgttaatggtctattcagggattcgacttcttcctggtttagtcttgggagggtgtatgtgtccaggaatttatccatttcttctagattttctagtttatttgcatagaggtgtttatagtattgtctgatggtagtttgtatttctgtgggatcagtggtaataacccctttatcattttctattgtgtctatttgactcttctctcttttcttctttattagtgtagctagtggtctatctattttgttaaccttttcaagaagccagctcctggattcattgatttttttgaagggtttttcgtgtctctatttctttcagttctgctctgatcttagttatttcttgtcttctgataagttttgaatttgtttgctcttgcttctctagttcttttaattgtgacattagggtgccgattttagatctttctcgctttctgctgtgggcatttagtgctataaatttccctctaaacattgctttagctgtgtcccagagattctggtaagttgtgtctttgttctcattggtttcaaagaacttctttatttctgccttaattttgttttttacctggtagtcattcaggagcaggttgtttagtttccatgtagttgtgcggttttgagtgagtttcttaatcctgagttctaatttgattgcactgtggtctgagagactgttaggatttccattcttttgcatttgctgaggagtgttttacttccaattatgtggttaattttggaataattgcattgtggtgatgagaagaatgtatattctgttgatttggggtggagagttctgtagatgcctattaggtcctcttagtccagagctgagttgatgtcctgaatatccttgttaattttctgtcttgttgatgtaatattgacagtgggatgttaaagtctcccactattattgtgtgggagtctaagtctctttgtaggtctctaagaacttgctgtatgactctggctgctcctgtattgggtgcatatatatttgggatagttagctcttcttgttgcgttgatccctttaccattatgtaatgcccttctttgtcttttttggtctttgttggtttaaagcctgttttctcagagactaggattgcaacccctgttgtttttgtttttgtttgtttgtttgtttgtttttttgctttccatttgcttggtaaatattcctccgtccctttattttgagcccatgtgtgtctttgcacgtgagatggctctcctgaatacagtacacctataggtcttgactctttatccaatttgccagtctgtgtcttttaattggggcatttagcccctttacacttaaggttaatattgttatgtgtgaatttgatcctgtcattacaatgctagctggtcattttgcctgttagttgatgcagtttcttcatagtgtcgatggtctttacaatttggtatgtttttgcagtggcctgtactggtttttcctttccatatttagtgcttccttcaggagctcttgtaaggcaggcttggtggcgacaaaatctctcagcatttccttgtctgtaaaggattttatttcttcttcgcttatgaagcttagtttggctggatatgaaattctgggttgaaaatttttttgtttaatgttgaatattggcctccactctgctggcttgtaggatttccgcagagagatccactgttagtctgatgggcttacctttgtgggtaacccgaccttcctctctggctgcccttaacattttttctttcatttcaaccttggtgaatctgacgtttatgtgtcttggggttgctcttctcaaggagtatctttgtggttttctctgtatttcctgaatttgaatgttggtctgtgttggtaggttgtgaaagttctcctggataatatcctgcagagtgttttccgacttggttccattctccccatcactttcaggtacactagtcaaatgtagatttggtctttccacatagtcccatatttcttgaaggctttgttcattccttttcattcttttttctctaatcttgtcttcaccctttatttcattatgttgatcttcaatctctgttatccttttttctgcttgatcgatttggctattgatacttgtgtatggttcacgaagttctcgtgctgtgtttttcagctccatcaggtcatttatgttcttctttaaactggttgttccagatagcaagtcgtctaaccttttttcaaggttcttagcttccttgcattgggttagaacatgctcctttagcttggaggagtttgttattacccaccttctgaagcctacttctgtcaatttgtcaaactcattcttcgtccacttttgttcccttgctggcgaggaattgtgatcctttggaggagaagaggagttctggtttttgcaattttcagcctttatgcgctggtttctccccatcttcgtggatttagctgtctttggtctttgatgttggtgaccttcggatggagtctttgagtggacgtgccattcctttctctttgttagttttccttctaacagtcaggcccctttgctgcacgtctgctggagtttgctggaggtccactccagaccctgtttgcctgggtatcaccagctgaggatgcagagcagcaaagattgctgcctgttgcttcttctggaagctttgtcccagaggggcacctgccagatgccagccagagctgtctcgtatgagatgtctgtcgacctctgctgggagatgtctcccatgaggaggcatgggggtcggggactcacttgaggaggcagtctgtgccttagcagagctcaagcactgtgctgggagatcagctgctctcttcagagctggcaggcaggaacgtttaagtctgctgaagctgcacccacagccaccccttcccccaggtgctctgtcccagggagatgggagttttatctataagcccctgactggggctgctgcctttctttcagaaatgccctgcccagagaggaggaatctagagagacagtctggctacagtggctttgctgagctgccgttggctccacccagtttgaacttccctgtggctttgtttacactgtgaggggaaaaccgcctattcaagcctcagtaatggcagacgcccctccccctaccaacctcaagcgtcccaggtggacttcagactgctatgctggcagtgagaatttcaagccagtggatcttaccttgctgggctccatgggggtgggatctgctgagctagaccacttggctccctggctgctgtgccctttccagtgtagtgaatggttttgtcttgctggcattccaggcgccactggggtatgaaaaaaaactcctgcagctagctcagtgtctgcccaaatggccacccagttttgtacttgaaacccaggtccctggtggtgtaggcacctgagggaatctcctggtctgcaggttgtgaataccatgggaagagtgtagtatctgggctggaatgcaccgttcctcccggcacagtccctcacaccttcccttggctaggggagggagttccctgaccctttgtgcttcccaggtgaggtgacacctcaccctgcttcagctcaccctctgtgggctgccctgactgtctaaccaagtcccaatgagatgagctgggtacctcagttggaaatgtagaaatcacctgccttctctgttcatctcgctgggagctgcagaccagagctgttcctattcggccatcttgccagctctcctgcctatgtactctttttggtctgatttatttcactcggcatatttactatgagattcttccatattgtagcatgcatcaatggttcatttctgtattgttctatttgggcttctataacaaaataccataaactgggtagtttaaaaacagtatagatttgtttcttatagttctggaggttggaaagtccaagatcaaggtgctggtagatttaatgcctgatgataacccactttctggttgatatgagatgacttttcagtgtgtcctcacatgatggaaggggctagatagctcactggggtctcttttagaaaggcagtaaccccattcatgagggatccaccttcatgaactaatcaccctcaaaggctctaccttctaataccatcaccttggaggtcaggatttcaacacatgaatttaggggaacactaacattcagaccatagcaattccttttttattgctgagaagtaatcccattgtatgactgtaccacagatatttttgcttttattctattcaactgttgatggacatttgtatctctttctagcttttggttattacaaataagcctgttgtaggctggaagtggaggctcatatgctataactgctataactaaatactacagactgggtaatttataatgaacagaaatttatctggttcattgttctggagtctggacagcccaagatcaaggggcctgcatctggtgagggccttcgtgctgtgtcataacatgatggaaggtattacatggtgagagaggaagaaagggacctactcatttttacaaagaatccattcctgcaataatgaacccaccctcaataatggcattattccattcatgaaggcagaacctttatgacctattcacttcttaaagtttcaccctctctacatcacgttattagggattaagtttccaatacacggactttggggacacatttaaaccatagcattggtccatagttttcttttcttatcagttttctggctggttttgttaataatataatgttggtcttagtaagtgagttgaggtattctctccacttcaattctgaacagtttgtgtagaattggtattattctttccttaactatttggtagaattcacaagaagccatctgatcctggagttctctttgtggaaaggtttttaactacaaatttcaatttctttaatatatataggattattcagattatctgttttttctttagtgagctcttgttgtacatgctttccagtaatttgcccattttatcaaagttttcaaattttttgacataaattgctcataatagtccatcatccttttatattttctagaatctctaatggtgctacttcttccatgcttgatattcataatttgtgtattttttttcttggctagcttggctaaaagtttatcacttttgggaagctagtaagggatgataaatacttaataggtacaatgtacactaattaggtgatagttacactaaaagaccacaattcaacgctacacaacatatgtatgtaacaaaactgcacttgtaccccttaaatttatacaatacttaaaaaaactttccaaaaaccagtttttggtttcattgatttttctttattgtttatgttttcattttactgatttctactctgatctttactatttgatttcttctatttgctttgggcttaatttacacttcttttttctagtgtcttaagataaaacttgcagtaatttattcgagaacttttttcttttctaatattggcattttgtcctttaatgcctctgtagaggtaccctatgtgttttaacatattgtgttttaatttacattaagttataaaggcttgtaattttacttttgtttgacctcttagatctttgggttatttagaagtatgacagttttcagagatttgtggattttacagagatcattttgttattgatttctaatttaattccattgtggtcagagaatatatttaatgtgacttaaatcagtttactgttattgagacttatcttatggcctaaaatatggtctatctttctaaatgttccctgtatgcttggaacaaatgtatattctgccactgtgcaaacaggctgcagagaatgaccatatcagtgaagctctcagtcctcatggcctgccctgctctggcagaaccaccatgagaatagagctgggaggtgttgggagcagccccaggcaccccaggcaaaaatgtcacagattcctactcttctttttaaaaattcagaattttttaagcataaatatttcttacattgttgtatgtctttaatctataccatagtgctcagatggttgtttttatcggttctgttcagcttcatagtttctttttgggaagagaatttgccaacctcctcactcagccatagctggaactcagttgtgggctatgatattttaagcaatttgtggaaaagttttgaggcagtactctcttaaaaaattattttcttggctgggcacagtggctcatgtctctaatcccagcactttgggaagtcaaggcaggtggatcacctgaggtcaggagttcaagaccagcctgaccaacgtggtgaaatcccgtctctactgaaaatacaaaaattagcctggtgtggtggcacacacctgtaatcccagctactcaagaggttgaggcaggagaatcgcttgaacccggaaggcagaggttgcagtgagctgagatcgtgccattgcactccagcctgggcaacaagacgaaaacgccgtctcaaaagataaaataaaataaaataaaataaaataattattttcttcctccaaaaggcagggtaggctcttctacttttgccccaactgctgagagaaaaagttatctatctatgcataaaatgtaactgcaatagcctgttttacagtctgtgtattggaagagatgtatctcttataccagaatttttatgtgtttgctaagtaataattagcatttgagctacagagctatttaaaatacaaggggcgtagtttctgctctatagccttccctttgagtagttactcacagtacaactgagatgtccatggagttttctctgaagcaactaaagagaactgctttctgtagaatatcatggatggtgaactaggctgtgatatagctaagatcagtggataacaaaggaccagaacaagagtagaagcaaatctggatataacatttcctccaattacttgtagctaagccattttcttgccccccagcaagtctggattggagttaatagcatttataccacagcaacatttggtaattattatatcttatatatgtgtttatcttacatacgaatatgctatcaaggctatttgtgaggttacatgttaagtggaaaatttttatccagtagagatgcaaataagttatcccacagaaaagataactccgcagcttagagtttattgccctgtagacaattatcggttttgtatttaacccaacaatcttctgctaacattctttattgaattttcaaccaatagctatcttctcaaatgttctttgaatcagtcttaacattttgctgttaccttcattaattcgtttttgaataaaatctttgacatacaaattataattataattttaaaaaattataccttagtaatgcttatgtgtgtataggtagaatagagagagtcagagggagagagaatgtttaatgttcagtaaaatatgtataattatttccatatggtaggttccattatgtttttcattataaggctctgggttaaaacaaatctttcagatacagttaaggagagccatctgaactgaatggtcactgtgtacaatgccagttaagattattgttcagttttgtgtctaactccttgctactcagagtttggtgcaaagagtagaatgattagcatcacatggaagcttgctaaaatgtcagaatcctaggccccactccataccaatggaattggagagtctgcattttaacaggaaccttggctgatttgtatacacattaaagtttgcaaaaccctagtctagatgtcatggagtacgtgaacagttcctccttataaaacaaaagaggttcacattagaatttcccaggagcaagtttaaaatgtaaatattcaccttcccccttcctcttttccctccacttctgttacactgttaggattggatattgctgcatgtgagagaaaccaaattacatgacttgccttaatagtttacctattttttcctcgctgatccagaagttaagagataagcagcccaagcaaagtgtagctgctcaacaaagtaattgtggctcaggctcctatttgctttctaatcctccagtcttaaagtttggttcctcatgatggaaagacgttggcattgcctttagctatgattccccatttcaggcaggaagaaggggacagtggtaaagagcaaactaaatttgtctctcttttttttttgtttttcaggaaaactgtagattttccagaaatctacaattttcttctactcttgttctggtcctttgttatccactgatccgtagctatatcacagcctagttcaccatccatgatattctacagaaatctctggccatgcagtagattttcacttttatctaattagttagatggggtcacagagtcaagttcagttgtctggagaggtgagcactaatggacacagagtgctctcaataaatccgtgttttcattaggggagaatctgttctggataggcaactggtgattacaaccaccaaaagaatattcaaatctgaaggatggggtatttctgtgtagtttgaaaattttccccagttgattccggtaagttcccgtgttgccaaattgattattgcttgaataatggtgtctgaacagagcttactcttaccttatgatctgcctattttacaagaccattcagtactaaccattacttttataattataaatagatatgttggtacctttctaatactacaattgtacttctctttttaaattcagattttcattctctgtctctccaaaatggcattttgactgagttgttgtttttgacattgcttcctaaattgcaaaagtttaaaccaacaaacaaaaatcataatttccttgtcaagctaagattggtctttcattaaactgtcagtatttcaaagaacaaatttaaaccttgagttcaaaaattcgtttgtagagtttcttaaagtttggttactaagcttctatatagtagtttttctcttgtttgttctctccctcttttcatacaaacagactagacataagctcataagggtaagaatccaatttgtttgttgtttgtattggtatcaccaagtctaacacatacgtagagctcaataaatctttgaagaatgaatgaatacctcaaaatagcccgattgcattggagggatcattttatatagatatcatgtggacattattgtctgtctagctattgagtagatttcttctttgctgaaattttgcaactaacatcatttactcattagcttttcctttaaaatcaaatttatatagttcttatatagtttcctgctggctaggaaaattccttgagggctagactcatagtttagaagtgtagaatggctatctttgcttcagagatgaacacagcaggaggatagagctacagaccttgttaaagtaatactcgtgaacaatttttgccttgttatctgattgtgaggtcttttatgttttcttttctggaagaaaatattgttctgcaattgagaaagccagaaggctaaaaataacctttccattctgcgtttatgactatgatatgcagtctcaaatatcagaatacctcctgaatgcaaatagtactctgggaaaaatgactaatgctttctcaaattgaatataaagagaattaaggaaataatatttatggttgttgtttatatcttaatctccaatgttactttgtaataaataatattttccactctaggctttttttttgagacagagtctcactctgacatccaggatggagtgtagtgccgtgatctcggctcactgcaacctccgcctcccgggttcaagcgattctctgcctcagcctccaagtagctgggattacaggtgtccaccaccatgcctggcttatttttttgtatttttagtagagacggggtttcaccatgttggccaggctggtcttaaacacctgaccttgtgatccacctgcctcggcctccaaaagttcggggatttacaggcattagccacctcacccagccagctattctttattcactggaaaagttatcaaaaatttggaaataggtaagaaagattactagcagttctttcagtgcagttctgtgcttgactttctattgtctgggctatttaacatatttaacatttctggaggggcagagtttaatttgtaaatttttgtccagaagaaatgcaaatcatttctgttccatagaacagataatcccattgtagagttgccagacttagcaactaaaaagtgcctgcagtatttgggacatacttgtacttaaaaaagaaaacaacattgttcatctgaaatttacatttaactgagtgtcctatattttatctggcaaccctaccccagaagttccagtttatggtcatgtaggtcgttgaccagttttgtgtctaattcagaaatctcactgtaacactgcctattaatacctaaattctcaaatgtttttggactttttttttataatcttagtgtttccctaattaattaatgagttttatgaaatatgtgacacatatttattttatgtatgcatgagagctctgacttggtcttttggaaaattatacttttacagttttggaggtcatctacttaaatatccacatggccgcacctgatggagccaagtaaattgcaatgccggggaagtgcacctcagggacagtttcagcccagttagatgtttgcttggctctcagaataaatctgaagcaacaatgtaacttaaaccttgtttattttctatttttgtttttgtcttatttttgtttttcctattgattttgtgtttttatttctggtgaatgtatggccaaaaagttattctccattggtggcagtaatagttgagattttctttataccacctgacccatgtggcaatcgctgttggaaggatggtacatatctatgttgttggatgaaagacaacagaaaatctgaagtgttggtctttattgtttgtttgtctgtttgtctacttgtaagctcaaatcagttaagaattccttgccatctgagaaggagaaaatccctttgagatttgcaccagtgagattttgtgattctatgtttatttttgacctgcagctaaggttgtagaactatagctataagctcttcatgtatctctgtgtctctgttcttgagaaaggcctttacctttcattatgtgagtgtgaaatatttttctacttacagagggttttaacgtattacattattacatgtcttaaagaagctctgttctgattggttttaaggatatgtgcttatgtaaataggatattcccaaaattcacaggaaataaagaaattgaaattctagtattttaaaaactactagcttagaaatgtttttgaaatccaagtttatatgataaagattagtattttgacacattagcctaaattagtaattttggtttaaaataaatgataatttatatcatttctttgaatttatcagaaggaggcataggacaagtgcacattttatatttttaataagattttgatttaccatacctcatgaacagaatagttattttaaactttcgaaacttctaatattggtttaataatcaaataagctcacgttttttctatatatttaaaattattaaaaatataaatttgtgatcagctaaattgattctctgttctaacaaactttatactaacagcaattatgttatgtattttagtagcttaaataaaattttatacatccttagttaatttaaaatcctggactaatcttaaattgagttaatttatggataattattaaacaccaatataattcttaagaatgattggatactgtagcattgattactaagtttatatacttttattcagatatgtttccttctaatatgttgtagagtagccttatctatgagtcatggtaaaaaaggtgttcctttttgtcattttaactaagtgtaaaaggggtttgagtggctacaaaaagttgtgttatttgtatttatgagctttgctactctgccagaatgcttgtatatgacagatagttttcaaatatatgacccctttttaaattttcctgtaaaaacacaaattagtcactttgtttatatgtggttcagactatacaaggagcaatactgacagagaaatgcaaccccttatttgcagttgtaaatgagtgaggttttgttctgcaagaagaaaagtgttattatccttaattgatgtagaatgtatatagaaagttgaaaaagtttgtaaaaagggatttttaaattgtctttgtttgtaatagtttcaaatgctgagtctgaaaagaagcaacaaaatgtgtttctattttgacaaagttggctcagttttaattggtttaataatcaaataacatattaattgaaactagagcttagatttctctctgtaaaaatgataaatttgtcttagagcttctacaaggggtaagaagatgtatgtattcctttccttcctggtaatctgcccagatagcagtttccatatctcaccataattgaattctctgcttttgttgatttgattatattttcaatttctatttttgtgtgtgtgtgcaaaatagcacttctaagagaaagagaaataaatgaataaaggggagaaaagagggggagggagggagggaggaaggaaggaaggaaggaaggaaggaaggaaggaaggaaaaaaggaaaagaaaaacggacaggcaggaaggctggctggctggcttacagtatagtcccctatcagtgagaactgtcttaccccatgtaattcgcaagaccattcaaggcacattgctggaatcagaggaatggtttgtgactatggaaacaattatgatttttctaaacaacaacaaaaaaatgttcctcacttgtgaaagagctatggttctttataatcatgctacttttctctatgtctattttattttcttttgactctttcattaataggcattatttcttaagcattcatgattctgtattaataaactgaccaaatctttctgaaatctcttttaattatgcctttcaagagcaaatcctacattaaaatataaataaaaattttagattatctttaatatctgaaattgtctatgagatttcccaaaaagtccctagaaaagcaaaaaaaaaaaaaaaaaaaaaaaaaaaaagctattttaccatatcagaaagggatgccagaaataattaaggtgttttttgacatatttcttaattactcaacactattgtaaaattttcatggaaagaattatcagatcagaagagattctcaaccttcttaagtttgtataggtaaatttttattgatataaatattttagagattgtaaactttatggcaaggccctggaggtttgtcagtgctttcacagttcataatatattattatttttaagggactcattgatcaaacccttcagaaatagttatttctctatttccaatagagaaatctacctttctgtgtctgtatactactggctacggtgactgtgataaattaaccacaaccatccagttgtattatcagttttatccttccacttgatgcttgctgaaggctctgctataagctacaggttaaaatttgtgaagaaaacagtctcagggccggctgcggtggctcacgcctgtaatcccagcattttggaaggctgaagcgggtggatcacttgaggtcaggagtttgagacgagcctggccaacacggtgaaaccctgtttctatcaaaaatacaaaaattagccggcgtggtggcgcgtgtctgtaatcccagctatttgggaggctgaggtaggagaatcacttgaacccaggaggcagaggttgcagtgagcggagatcatgccattgcgctccagcctgggtgacagagaaagattctgtctcaaaacaaacaaacaaacaacaaacaacaaaaacaaacaaaaaaagaaaatagtctcagaatcttgagggaatgactttccaatgtaccatgaactattgatactttaggaaatagacttttagctaagatctgtagctggttaagctgtcaggctgtactatgacagctggttaagctgtcaggctgtactatggactgttaggaattttaggaatcttttcagtctgaaagcaaacatgtttcatgaaagcagagtgctggtcaacagaacaattaattacctgggactaaataaactgatgaagaaaatattattgtggttatttatttggagtggtgttgatataaattttgaattttcttttttataggtagccctttctttttttcttaagctattcttaactctcaatttactagattgtgattttgtagactgaaaacatttttggtggtatctgactctcattgaaccctctcccaatttaaatgaattttgaatactattaagaggttggagctgtgatttttcatttaactatgtggctaaattttaggcaggattgattgaatttacagcatgcaaaaacaagatcatttgctctattacatttcttcccacctcacccctcctttctaatttgtttttagttaaatttttactttttatatagttggggcttataataacaattcgattttgttctgtgccattaattttggcatatactcagtgttattctatacttacctaaatttaatgctcatcacctgggcttttgccatggccattactgagtactttgttctgattaatctcttaattatctggattttgttgtcaactagttctttcaagaagggcttataatactgttttccctagatctttcctatttgaaaattaaggtttgttccctatatatttttaaaacatcataacttattataatgttctcgggatataatttcattcactagaaatatgtagctattgtcctcattgttttttggcattaaagactgttgtggagaaatctgagaatagcttgttttcttccctgtagatgacttgcttttgatggatatttggggggaattctttatttatagttgaagttcaataattttactagggtgctatgctttgaatatggtttgtcctcgccacatctcatattgagcttggtctccaatgtaaccgtgttgagaactgatgagacctttaagaggcatttgggtcatgaaaggtcactcttgagaatgagttcgttctccctctcaggggaatggattcattcccacaaggacaagttgttatgaagtgaaattgcctctcatgttttgccctctttgtgtgcacacaattctccgtctgtttctttgccatgttttgacattgcaagaggccctcaccagaagtcaagcaaattctggcacaatgcttcttggacttcccagcctccagaatcatgagccatataaacctattttctttataaattacccagttttaggtattctgttacagcaacagaaaatggactaagatacagggtaagatcatctggtattttcctagagcatttattaccccttcaatctacagattcaattgtttctataattaagagaaattttattatattaacaaataatcatatctaccccatttgttgagttttattgtatttttaaaaatagattctattttaggctagttttaggttaattgcaaaattgggcaaagagtacagagagtacctgtaaacccctctcctcccaatacatagagcctcccccactatcaacatccctcatcagagtggtatatataactgatgaaccccactttggcacatcattatctttcaaagtccattagtgttcactcttggtgttgtacattatattgattttgacaaatgtgtaatgacatgtatgcatcactgtaatattatacagaataatttcactgccctaaaaatcctgtgccctgcttattcatccctccctcttccctaactcctagaaatcactgatctttttactgtctccacagttttgcctttctgtgatgtcatatagcgggaatcatacactacacagccttttcagattggcttctttcactccataatatgcatttcagtttcctccatttctttgcatggcttgatagctcatttctttttagagcttaataatatgccattatctggattgtcgtagtttaattatcctttcacctactgaaggtcatcttggttgcttccaagttttcccattcatttttaaaagagctgtataatttcaatacttaatttttttctccatgattatctcaacatatcccttcgtggtggatgttggtaattcaacttttatccatctttctttaattttttttggtatttctgatttctattaattatgaaattatgttctcttggtttttaatttagttccttagatctgctatctctattttcatataattctactttttatgatcttaagtttatgtttttgctttcatgaatccaggtccttattaagttgttttataatgtaaaatacttgtggggattttctttctgttttattgtcttatgttttctttaagagtggatttttcatctgtcgttactttttttggtctttcttttttggtattgttgtaatatgtttacatatctggaatttttgtgtgtttttaatttatcttgcccatatgttagcatgcagtgaacacttctattttctctttgcctgactatcctcgacttttttcataacatctgagcataagttttgggactaggtattgaaagtgtgtggtatccaggatggcaggaaaattccactggggctttttgcaggctctgttagaacatgtggtttgtttctgtttcttgagaaaaccttaaatttcttgagtcagggttaattctctccagtcaggatgtgtcctgtttctatggagggatatagtctggctttaaatcatttccccaattgtgtagatagtagagcctttagttctcttagaaagaatttttcattttattttacattttctgcatttcaccacttatcccaagtcagaagaggaataagatagaaacattgactaagcttttttctatcctaaattatggatattgttagagttcctatgattttgccaattcatcagtctggctcatgattaggtctatagtcaggaaactttcagcacctctctgacagttactgcctttttccttagggcatcagtttttgaagtttagttctttgagtcatgttctgttatatgtttgattgcaaataataagtattatcttctgctgctgttattattttcattaattttattaatgttagaggggaatacttttgatttagtttcattccactctccttatccagttgaacttcttcaaactaaatttaagtcattgagtattatataacaaatctgatcctcctttatttattagctgtgttactttgggcatctcaacctctctggtctaaatttcttcacctttgcgtgatacgatatttatctcatggacctgtagacaggcttagttcatataatatatataaacacctaacttcaattaggagactactggaatagtctaggtaagagatgatgctggttttaatgagattagtagtatcatagaagagaagaagtggtcagagataagacatttttagagacagacatgacgggacttgagtcaggttgtgaaatctaacaaacttgggtgtaaatcctgactttaccatttttatgactatgtgcaactacattaatagctctaagtctcaaattcatcaaagatggaaggtaaaattgttatggagattgagagaatgtgaagctcctaggatagagtctgacagaacataaatacttggtgaattttagctactattagcaataattgcattagcattaatattacaattggtaatagtatttgtatttaattcagagaggtgaagaaaggaaagagatcctgaaagactcttaggctttttgacatttgggtgaatagtggtgtcattcatggaaatttggataactgataaaacatttttgagggggagggagtcaaatcatgagttactccaagttttccatgtatgacaatatctaaaatcaccttgacagtctggttgcatttttcctgaaaattccattttgccattttcccatttaaagtgtgttattcagaagtggagacaatgttgatacagacaccatgtttattaatagaatttaaagtatcattatctctttggaagccatttcacactcttgctttatactgccccaggaagatcctacatccctgatgaaaaattcatgctgaagatttcaatggtcttgacccttgcaatgtcttatgataaacagaggaaaatacactttccaggtcaaagagcataatggcgtaagttcagattagacattgcagtaacgttcatatgacgtctaagagttgaatacttgcatgtccgttattttaagaagataaaaaataatgaattgcatttaaatgaagaataaaataatctctgtaactccccctagggctggttgtagtgaaacatgcgtaaataacagatgtggcatgatcagccaagtataaggtttattaaaataccattcattaacagtttcattcattaattgagaacttatctttagaacctaccatgtgacagacacttgagaaacgtcaatgaactaaaagtttactgtgcaacttgtatgtcctctttggacaatagcatattgaaggtaacaattaatgaaggaatttagtttgaatatctgccttgaacaacccttagtcatattcttttggtgcaggaccaggtaaagacaacagagagggttaattaaaaatgagaatgtccataatatggaatgagaatgagacagtccatgaaacagtgacttaaatagtgtgtgtatgtatgcatgtgtgtatgtctaatgaatataaccatatgattatattaaaatataatacaaaccacagacagcataccttttggttctggtattccctttaaatcaatcccaccaagctcttggtaaaatccttaatgaagtagttgaagggaaatgtcttcgatctagtgctgtaccgattctcttctctttgccattctggtatccatactggtctgcatcagattgctacttccttttatcaggtgtttgtactaactgcaaaacttctcaatatccaaatctaatttgttctcaaagcttattgtttaacatacatcttccactgattttctgtagctccagctactgctgctctgaatttcctaatccacggatccttcatccactgctggatcttccattgtgtccttgacggtacatctattgtttgttaccccaggaagggctctttcctctctatatttcttgtctgctgcttgttctctttttcagttctttacatgttctcatctgggctgtagtaggtgggaagggttatggcctgccctcaatttgacaaaaataaagcatcctgtaagttgaataatgtatttttaaaaagtcttcccctcctatttattgctcactctttgtgccaaatctcctccaccagaccacctcccgtgactgaccaagttcctttttctcttgtcctactttctcgctgacatacatgaatatatattaacttgcctgtcaatatagtgatatttcttttaaagtttttaaaatccattttgatcagtcatacactgttcctagaacctttttacaattatcttcatctaatgcagagtttatcttctattaactcctgtaaatcaccttcttaatctttgttcatggcagctggcagctttgtacagaaattccttacgttacagtaaatgaggaggctgagaggaagtggcaggtccttttaatgccaaggttttcttagtgtcttgtatacttgggcagaatttttgttttcacagtaaatacagtaaacacagataatctaggtaaaatacctcttatatttgagaccttttaagttttttctaaaggtatctgttatctaacttaacaattatattagaccaatattttgtatatttaattgacttaaaagaattgattcttgcatttcaaaaatgagtttgatggtaacagttatttagaaattatgctcaagtgtatcacctggacccaaatatattcatttgagacaggggctttcaattttagtagtttaatagccgaacactgtatttaaacaaatctcatttgcaaaactcttaaaattcatttccctgaatcagatctgcaagctctccaaatttactcttcacaattctaccagaaatatattctcaactgtgaatctgaataaacttaatcctgtttacaccttttgatgtgttttctccatcttcagggtaaagatgaaaacctttaaatatggacctcaacgacttccatgatgtggcctcagcctacatcttccagtatcaactttagccacatatccccaaactcacactctaaagtccagtcatatcattatgctatttctcctcctctccttatctcatctgcttgtcaagaatctttcgttatcaacaaactagaacttggttagtcatacttttttaaaaaaataatgaaattggtatgggttggtaaatattctcaaacactaagatactgaagaaaatctagtgtattggtggtcctatgatttttcttttcatgatcaacaaatgctcaggcttgaaagcaagtctaatgttatattccaaagagcaggtaccatcattattcttggaaagattggtgtggagatcaaagtcaaggcatggatccatattctcttgctagtgtgaagctcagtgactgcttaaaactctaggatatcatgttttaaatttttcaaaaattgaacgattctcacagaattaacattttcaagtgaaaccattccgtgcctcatcactgcatacccacacctccagcttgacaatacagctaatcagtaggattgcctgagtatctatagcttagttcattacactttttctctctcttaatctagtttagacaaatattgtcaggattcaaacattaaaatccataatttcttcaacagtaaaatggaaaatgatacacatgtgtttcaattctgttcatctagtattccacctctgacattatattttcttttaaattggaatatccttttcctaccacgtcaccattctctcccactaagaaatgtaagattttcctctttgtgaatctcttcatggatttccattgctaattctgcactcatccaatcaaagttcaaacaaaaagtgtgtgatagatgaacagagtagagatcagagagagaacttcatgtcaaagttatgttttttcaactagagtaataaaaatagttataattcatccaggaacacatcacttgggatcagaaagaaagagacttctttcacatttgatgctggagaatatttttaggtagaactggtatatttaaaataccaaagtacccagtgtttcccagattttgtttttttaccagaaaagactcataaatacttccttttcttataacaagacatatgatttaccattgattttttagtggtatgatttttatgttggatgaccagaaatagtctgtctaataattctgagatcctaagagcaagtatgggctagtgcttgagagcccagactctagcttaattcccagctttgcaatttcgtagctctgtgggagaatcacctaaactctccatacttcagtttcatcaactgtaaaatggaaataatagtgacatatacttcaaaggttgtaataggtttaaactagttaaaatacatcaaatgcgtagaagagtagctgatacatagcaccatgtaaatatttgatattattattgttgtcttctctttgattgattccctatcttagctcgtttgtttcccactcacacaatgaaagagtttaaagtagccctttgtagaccagaactttaaaaataaaaagattttttctttcttttcagtagtttaggataatgaagttcacatcccagattaaacctttggaaagtaactgtagtataatgcagtcagtgtagagccaggatttgtgttatccaatagagtatctgctagccaaatgtggttatttaagtttaaactcatcaaaattaaaaggttagttccttggttgcatgagtcccactaaccacatttcaactgctcgatagccacatatggcaagtggttaccacactgggcagtacagatgcagaatatttccatcaacacagaaagttatttttgacagcactaatgatcaaaatctgatggactactttgggttctttcctctcatacaacaaacagtgccactcatttctatctaccttatcacatctagtcaaggagcatctttcgttgttctgaccttcctcccctgcacttcttcatttcaattcacaacatattagtcatttaggaattactcacatgataaagacatctgtttgctgaacataagcaagataccttctttttgaattggactctcttaacccctcttccaagcaaggaaggggccctgatacttcttataatattgcctagatagtcaaggcgttagattttctattttctaaaaaatagagaattatgatataaatacttgaattcaatttttgcattgaaaataaagggcaatttttgttcaggtttgggctaattagaattattttttaaattatgctatttattgtctttccatttttttttcctctgagacagagtcttgctctgtcatccaggctggagtgcagtggagctatctcggctcactgcaacctccacttcctgggttcaagcaattctcctgcctcagcctcctgagtagctgggattacaggtgcccgccaccacacctggctgatttttgtatttttagtagagccggggtttcgccatgttggccaggctggtctcgaactcctgacctcatgatccgccctcctcggcctcccaaaatgctgggattacagatgtgagccaccatgcctggcctattgtctttaaagcctctcccatcttcatcgccacatagttctctagaaatttgcgattaagtctttatatatattctacaggtattatcaatcctatcttaatctttttccagtttcaaaataagcctgaagtaaaaggaaacaggaggttattctagtttggatttcatgaaaagcagactgtgagacagagatttgtatacaagtagtttatttggaaagtgattccgggaggtactatgagggaatgagaaactgtgacagggaagagaataaagacaatactgggaatgctaatgagtagttttctatggggaactggggctcagtcctgctggggagccatcaagagactgtggactacaactcggagttgtcccacagagaggtgagaagtagaaatctagggtatttatgaaatccatcctcctgccccttaattgttgagagtaattcttggggtattaccctctctacattttttgcctttcccaccagtggattaatcagaattctgaggcaggagaaagccctgggcagagacatataagaagctgagtatggaaactgtctctggtgtaggccacaggttatgagtggggtgccaataccatctgctacagctgactactacacatagtttgagtggcaatctaatatatattgaaatggcaacataggaatatctttcaaaatcttttcaacaggttatatccttttcaccttacaattatatttctagaaatttatcttaaggaagtagagatatgcaaaatgctagcttgcagtattatttataattgtagaaaatagagagcaacctaattccaaaaatatgttattggttaaataagtttcatgtattgttataatgtaatataatgcagccaatagaaaacataattgtgaataattaagggcctatgtaatatatataacatatgtagaatattcgtgatgtattaataagcataaaacagttgtcaaagagtatattcagtatatgcccaattaaacacacacacacacacacacacagaggcaatgaaaaatggctgaaatattatataaaataattaacagtacttgtcactaggttttaggattagaggtaatttaattttttattgatgcttttctaaatgttctgcaataaatgttatttttataaccagaaaaatcattaggtgcaattttaaaacaaaattaacctttttgaatatcgacattttcaaacctgtaaacccattgcttctttatgtgtaattgcaagttagattctaaatctagcaattacaccaagagcatctcacatttcttttcctcagacagagtagaaatatgtataatctttgggaggacttgattgcaaacatgtatgtgcttggaatgcaagaagacagattgtagctaaagttattttctctgcctaactggaatgatgttgtgatttagcctgtaggattcccctgaaaatggatttttgaaggcagataaactgtgtccctgcataagataggcttctgacatatatgaaaaacaagttggttattgacctgtttgtatgccgcatacgctatttcttatggtaacatcatctcagtactgcaaacactatagacactaataaattattaagaatgactctgaagaaagctagagtggtgaagtttgtggaatctgacctgaagtatatagagagacagtttcatagccacagcctagctccctaacttcatagtcctataatatacatatgaaaagagtgaaccaatccaagtccatcacctaacacatgcccttcccattgctgacggcaaaacagctaaaagaaaatggattagtcgtttgttattatcatcattgctttataattaaaaagaaaatgaattttgaaatactactctaggtgctaaatgaactaccaggtttgtcgtgttaattggagaaatattgacataattgtgtttgacatttcatctgtgtatgaagtgtttgaacatataaactcagtttttagatatgtacacaaacagagccaatagatataagcttcaatgacctagtagttagtaactcaacttctcagaatctggtctgaagaaatggccagaaatgttagcaagagacttatgcacaaatattttattcatataagtgttcttaccaatgtaaatttcataacaacctaaataatcaataatcacaaaatactttaaatgacatcatatatgctatatttttcattttttattgtatacgtactttcaataattttgtgcctgaaacaaattttgaatgcattttgactgtgacccatcacgtgaggttaggtgtggaattttccacttgtggcatcatattggcactccaaaagtttcagattttggagcattttggattttggatttttggaaaaggaatgttcaacctgtatgagatctgggttttggctgttacgcccagtgaaaattgaggttactttttcgcatcgtctctgcctattgtggttgtggctaagtcctaaagtttcctttgatttcccttaaagggttcttgagtaaattcagcttttcctggcaccatgcccaccaaggaaaaaattgctccagttgatctttattgaaggacttttggcagcagtttcctgagtgcactaggaccctttgggctactacttacagaaatccgcttgtgctagtttgaacataaaaggatgatttttggttttttgataaagggatgtctcataagacccaagaataagtgtgcatctgggcctcagacaccaatgggatacaagctgtaagtatttttctcttttgctgtagaatgactttatctgcttcctagtttacagggctgggttaacatttcttacgtataagagatagccagagtgaaattggaatttcttggccacaattacagatttccaatggtagcatctggagctagatcagcgagctctgccaggggctgtgtgttagttttctaagactgctgtaacaaatgaccatacacttggtggcttaagacaagaaaaatttattgcttcacaattctggagaccaggagtccacaaagttgtcagcagggtttgttccttatgaaggctctgttggacaatctgttctgtgtgtctctagtaccttctgctggctgctagcaacccttagaattccttgacttgtggctgtataacagccaattctccttttctccctgggcaccttctctctgtgtctctgtgtctcaaatacagtatccctgtactttctctggtaaatatactaattgttggtgttaagatccacctaggatgatctcatcccaagatccttaattatatcttcaaagattctaattccaagtaagttcatattcacaaatattgcaggttggaacttccatgcatttttttgagggggacacgatttcacattctatgagctgtgtcttcattgtgtgtacagatgtgtactgggatcccttatacagtaaccatattagtggagaaggagtggtaattcccaaaacagagaggagactgggaagctattcccaaagagttctctgcactagcactgaatttggaggagacccatgaccttggaaacaggtatatctcagccagttcagctctagctttgagacataattgtgcttcatataagtgactgatattagatctatgttcctctgaaagggatagaggaaggagagactgagtggatggagagtcagtgtcaaagatgacataattgtttcactgtgatggagggttgctgccatggcctctcccaaggaatatgggatattttcttagactataaattatctttccaaacagcaatagtaatagaaacaaccactgccttggtttccagggaaaagggtggttaaagaaggaaagtagcctttttgtgcgatgtgcccagccttgtgccttagagctttatctaaaattcctcacttaatcctcagaacaaccttggggagtgagaggagactttttcctaggtggaattgtcttccctcaggaggacataatatcgtattgttttcatttttggtggtgttagtagctgttgatgctcaatgactagtttcattaatttttttttagggttttcaaaatggagatattctatcatttttttcttcacatactacttgaaatactgctataaagataactttctccatatctactatttgtttacctagtcgtacaatttgtataggaaaggcaggatatgtatataattatctcctttatttgctaaattccaaaataatgacttgttatttatttaacatcctttcactagtaaccagttgcattttattttttaataatataaaaagtcaatagatgtaaatatacttgatgtatctcagtcttctccctttttcaattgatacagaatattttgcatatttatgagatgcatgtaatattttgttacatgcatagaatgtctaataatcaagccagggtatttcaggtgtccatcaccttgagtacttatttatatgtgttgggaacatttcaagttctctcttctagctaccttgaaatatacaatacagtattgctaactatagtcaccgtactctgctttcaaaaattagatcttaaacattctatctaactgcatcgttgtacccattgacctctttgcatccctcttcctgccaacacacctttcccagcctctggtaactatcatgagattgacttttagctcctacatgtgagtgagaacatacaaagttagtctttctgtgtctggcttacttcacttagcagaatgacctttagttccatccgtgttgttgcaaatgacattattttattctttttgtggcctgatagtattccattgtgtatacataacacattttctttatccattactctttccatggacacttgggttgattccatatctttgctcttgtgaatagtgctgcaataaacatgtgagtccagggatcccttttatatactgattacttttcctttggatacatacccagtagtgggattgcaagagtgtatggtagttatatttctagttgtctttgagaagtctctatactgtttttcataatggctgtactaatttactttcccactaacattgagttctctcttctctgcatcttgccaacatctgttttctttttttgtctttttaataataaccattctgactggggtaagatgatatcacattgtggttttgatttgcatttttctgataattagtgatgttgaccatttttttcatgtgcctgttggccattggtatgacttctttaaagaagtgtctattcatatccattgcctgcttttcaatgagattttttttttcttattgagttgagttcattgtatattctggatattagccccctattggatgaataatttgtacatatgttctcccattcaacaggttgtctcttcactgtgttgatggtttcttttgctatgtagaagctttttagtttaatataatcccatttgtctctttttgtttttgttgtccgtgattttcaggtctcgacataaaatatttgcctagaccagtgtcctgaaatatattccttgttttcttctagtggttttacagtttcatgtcttatgtttaaattttttatacaccttgagttgatttctatatgttgtgagagatagggattcagtttcattcttctccatatggatgtccaattttctcagcatcatttgttgaaaagcctgtcctttccccaaagtatgttcttggtttctttgtcaaaatcagttggctgtaaatatgtggatttctttctggattctcttttcttttccattggtctatggtctgtcttttttttaaaacaataccatgttgttttggttactatagccttgtaatgtattttgatgtcaaggagtgtgatgcctctagctctgttctgtttgctctggattgctttggctatctggactcttttttggtttcatacacattttaggattgttctatttttcaaaaatgatgttggtattttgatagggattacattaaatttgtagattgttttgggcaatatggccatttgaaagatattaataattctgatccatgagcatgggatgtctttctgtttgcgtcttcttcaatttctttcatcagtgttttgttgttttctttgtagaattctttaactttcatggtcaaacttactcctgattatcttttttgttgctattgtaaatggggttgccttcttgatttctttctcagctagtttattattggtgtatagaagcatgactgatctttgtatgatgattttttattctacaactttactgaatctattcatcagatttaagagttttttgttggagtctttaggttttcctagatataagatcatatcatcaggaagaagggacaatttgccttcttttccaatttggatgcctttgattcccttctctagactaattgctctggctaagactttcagtactatgttcaataggagtagtggaaatgtgcatccttctcttgtttcagttcttaggggaaaggctttcagctttttctcattaaatatgatgttaagttgggcttgtcatatgtgacctttattcctttattatgttaaagtatgttccttctatgcctagttttttgcgtttttatgatgaaggaatgttgaattttgtcaaatgctttttattagtctattgagatgattatatgttttttgtcctcctatataaaaatacatatgtgtttataagtataaaaagaataaaaggaaataaaatacaagctgcatttatccatggatagtgggtttatttgcgatttttattttcttctttttttcagtttgcgttgctcatgttatctgtaatgaacgttttattttttactagtagaaaatgattaactaaagaaatagatatcatacttagaattttacctgattttctccttaaccctgtctcactgcattcagaattggccatttgtatcatcaagtaagaaccaggtgctcaaatgtgaaaataactggatttcacacacttttcatgggacaattaattcatgactgcttaaaaacatgactttggaaaattgttccaaagagttcatacatctatgtattaatattaatctttcaaaaagtatgtattcattgtccaacacgtaccctgtactgtgctagctcttgtaaaaaaatatataaacacataaagcagttgctactttcaaggaatttcaaattctaaggaagaaggaaaaaagctgataagtaaaacaagtggtggataatacaaaaactatgattgttctgtgctaaataacatcctggattctttgaatattgaagtttagaaaagatagctgtgaaattctggaagttaactaaaatatgcaccgatatggtttggatctatgtctccacctaaatctcgtattgaattgtaatccaattgtaatccccaatgatggaggtgggacctggtgggaagtgattggatcatggcaggggtcggggtggattttcatgtatggcttagtgccgttcctttggtaatgtcctcatcatagtgaatgagttctcatgagatctggttgtttaaaagtatgcggcacctccccacactctttcttgctcctgctcttgccatgtgagacacctactcccgctttgccttctgccatgactggaggcttcttgaggcctcctcagaagccggtgctgctatgcttcctttacagcctgcagaacggtgagcccattaaacctcttttctttataaattatccagtctcaggtatttctttatagcaatgtgagaatggactaatacatgtactatgcattcttaatggtatatatttttaatcatttcccttgctacttctccttgcaggaaatcttccaaattctatctggactacaggttgatggagatatgggttagaatatttttaggtaaagtaaatgctatccaagtgtgagctagattgaggaagacgtatggatgaagtattgtgctatagtcaatactttccacaaaagcattaaactaggagtcaagagactagggtttgtccacccagctctgcatgggacctgactgtccgggcctgccatttaacccctataaaactgtttccttatctaccacccaaagagaccagatgattggcagggaccttctagttttaccactttcattcagccatgaaattacaaaaggactggaatcgccagtatagaaagtaaagtgagaggtggtatcttcagatcagagctctcctgtatttattatctcttctttcttcttgccgtcattgtctaacttcttcagagagtgatctccaacatattttcacttttttataccctactaaaccctatctacttgaaattgcagtcccatccccagtactctctctaattgcccatccaatgggatgtctcctcagcaatcacgggcccctggactaacataggaagctgcttggagactgtattagtccattttcacgctgctgataaagacatacccgaaactgagagctaactgtgacgttgcttcttgataaacatcagcacttagtcactagtgactattccctcctctgcaaactggaaaaagtatgagatttggagtctcacagtactaagtcgaaatcctgaaatttgtcaggattttcttatgtgtgttcttgaacaggacagatttcctctttgaccatagtttctacatctaaaaaatatagataatgcagcacatgaatctactgagttgttttagaattgaattaacctataggtgaagtgcctgacacttggtggatgctcaaaaagtaacaatcctcctattcctctcttggtttctatgctgaacatccttcttcatatctatgcttacttcctcatcatccttctggctgattcctttacttcctctttttgcctaaatatgggtgtcaagtcggtactgttgttggccctctacttgagcgtgtccctctcacagttcatgtccgtttttatagcattctttctcactgtatacctctatagagccaagcctgatactctgccaaccccacatgtccaaatgcctagtggaagctccgtttggatgccccaccccactttaaaatcagtatatccccctgtaatcccagcactttgggaggccgaggcgggcggatcacgaggtcaggagatcgagaccatcccggctaaaatggtgaaaccccgtctctactaaaaatacaaaaaattagccgggcgtggtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaaaaaatcagtatatcccaagctaactattcaccgatctccttgtcacattccccataccatcccaattatttctttgactttaatttgtcccttgttgttactactaaaaaactttgaatatgatttgatttatcccccaccttccaatccatatccagtggtcagcctcatgctttttgatattctcatgagatggagtatattataggaataagcatagatatcttttgtcttaaagctctgagtccaacacttagttacatagttatattggccttaggaaaaataaatgacctctgaacatcacttttctcatctaggaaaacagaataatcatacctctttcacaagtttcttgttggagatgtgaatgttctttctaaacaaacaaatggttatagatagataaataactaggtaggtaggtaggtagataaagattttataatgcttcttctgtccccattatagtccagattatattaatcaatctccttgactccactctttcttcatctcttatctaaaatatcatattcattttttcaagttaaaataacattttcagtaactcctcattgctgataggtttacatcaaaactcatttttctactcgactttagggaaaaccaataagggaaggaaagtaatatttagtgagcatctattctatatgaggcattgtgcagggtggggttggagccaaacttcaaattcagctgcctagctcaaaacttatatatatcgtaccgcttttcaacagtggaaagtcacaatattttcaatattatttcccattatcaggacagtcatttgaatcaaacttaagaatttgtgagtattagaaataatagtagtagccttcaagtattctcccctcatatggttatttgtttccagaatggaacaatctctgaaatttcacagttcagagaataacagtatttcagcttgacacgtgaaagtgtcaataacttgaataaatgggaaggtttagctgtcaatcagaaaactaattgtactggtcaatattaggtggcctttgcctgtctttgtaaaatcggtgatgcttactcaaaaatctgcattatgagactctaaactaattacatttcaatttgaaatagtatataaacattattacataaaaataaaagttaaattatagggttgtttgaattgcctttgtaaaatttttggcagtgttgtgctggtcctgctgattgctggttctgggcagaggcttctgtgaagtttgcatattgaaacaagcccccaaattgtatacatcattgtatttgtattgagcagctgcacaaacaaaataatatacatgaaatatgcatcacagattttgtaacctaggaaggtggcaaacaaagcccctctgtgaccaagtatccaccaatacaagtcagagacatttaggtgcaaaacttgtcagatgtaaggaagaagctgggaataacttagctgcaaggcatgacctggtggcaagtggtttctgaaaaggtgacattagaaatgaagatgcatagccactgtgaatggtgttggaaaactgagaaagaactgttgggaaactgtttttgaacatacctatgttttaattttcttgaggttaattatgaagttacttgaccactggtatttcaaaggtaaagtattataattttttatatttatacattgtttaacaactgccattttttataactccaacatacagagactctacactcatatggcaattagtggattgaagtggggaaattggaattcattttgtttcctgagaatttatttattgtgagattatctagttaccttgcagaggacagacctagaaagatctagagtggccttatgaatcaaacctttcttattctatttcattctatgcaaaataaaatatataaacattttgtttatcattattttctatatagaagtggaatcatagtttataaaaccagagcaaatcttctcatccaatgtgataattttacatgcaagtaaactgagaggataattggttgatagggtcatgctgctacttaaaaatataaccagactcaggatacacacttaagattcacagtccatggggcttttattatagtgttactttgccccttcaaacaaggtccctgcttagagttaaggcattttagggttaccaaacagacccacatcacactttagaattatatcagaggcatgtacttgccaattaagtcaatagttgtcaaatgtaactgagtttaaaaacaggtctgtacaatgcttgtgcccattattttagtgtacatatagtatacatttcctggttgaggaacccaagatatgagatctggcttttcatttagagagttctgaggaaaaaatagtttttcacactttatatttttaaaattctagtaaggcatacctccgcagccacctccatgcttctgctgaattcagctccttcatttactctctagagtcattgatttcaagtctactctctccagccaagtggagccttgagtaaggttgaaattgatgaattcatgtttgtgagtttcagtcactgcagtcaatggtatcttctaccaccgagtggtgcttctggaggcacaacttgaagtggagggccctatgcttcaaggagagagaggaggtcccatgttcaatttctaatctgggcttgagaggaggctgtcttctttgtcttgctctctctctacccatttgtcattcctcctgtctgtgtttatgtgtgtaggtgcatgcataggctcactatccctctttgtccctgttactctcttggtgtttcaactgtgtttccttttatgtccctttctttctgtgtctgtcttcaggatagaaatagtaatcctctcattgactgggttagtcaaagggcatatcattcaatcccagcacagccataaacactcaaggaacagaagtttctgagaaaggcaaaattccctagaatgtccacgacagtagcttctttttttttttgttttcaattttttggtataatctacctcgtgttcagctaagcatttaaaaggctgtctgcaagaattgatgaagcatctagggctgcaatgtgtaatatggtagctactagtatatatggttactaagcacagaaaatgtggctagtgccacatgttaaaataacattttggatattttgggttaaatatattattcaactgctaaagtatattattaaaattaattttacctatttgtttttacttttctagtgtggctactagaaaacacaaagttatatacgtgacttgcattatatttagatttgacggtgctgattgaggcggtatattttataaatagactcataaatttaaaaagctgtttctggtcaattgtataaaatatagttatttcataactggaaagttttcaaaatatttatcatgctgtattttgtgaattgagatctaatccttccttctgctctgtctaatcctctgttgaattcatgcattgagctcttttaaagaatctcagtgactgtatatttttaagacattctacagtatttggttcttgatttacaagaccctcctcaaatataaccttatttgtgaggcttttactgatcacttgatataaaataatacttccacaaaccattgcaccacacacacatacacatacacatgcacagacacacacacacagacatcatctttatgagttttaccctgcctggtttttctctataataatacatatcaccgtctagcataatatatattttctagttaattatctgtttctccatgttccctctttctccttttgcactcatgttattacttaagcccaatgaaggcaagcactttgtttatttagcgcaccaaagtttcctggtgtctggcatatagtggatacttgatgaatcatgattgaatgaatgggtcatattacccattttatacttatttcatgacttgcactgtccattatgatagccaatagccactaaatatcaaagacttagtatgaaagatgttaagtaaagctaaaatcaaaaataaaaattaaactatattattaaaattagtttcacctatttcttttcccttttttttttttttttttttttttttgagacagagtctggctctgtccccaaggctggagtgcagtggcacgatctaggcttaccacaacccccgcctcccgggctcaagggatcctcccatctcagcatcctgagtagctgggactccaggtgcaggccgccatacccggctaatttttgcattttttgtagagacagggttttgccatgttgcccaggctggtgtcgaactcctgggctcaaacgacctgcccgcctcggactcccaaagtgctgggattacaggtgtgagccaccatgcctggcgcttttactcttttaatgtgaaattttaattgaatttaaaattgcataggcaactcatatttgtggctcacttgtattatgtttatattgaatagtgtggttatagaatcataacagaaaaatctgtaggcctttcctcaagttactggaatgctaattcatttgtttgtagtgtctgatgtctttgccatgtttggtgattccatctataatttttaacttttgttgttagcttatctaaaggggagcttgtttttttaggaggaatctcttgtagcctcggttatttctccagagagtttgcaattgttcctgttgggctgtttgggtatccaaggcccagaacaaatgtttatgctcatttattgacttggtagatcctagcctctgagtttagaatacacagactctacctatgtgagggccagtcacagtgatttaatttccctctgaagatttattgtgaactcaatgggtaggtgcatggagcatttttattttctcttcactgggatcacagtctttcaaggttcttagctttactcccaggtcttagttcctgtgtccaatcttgagtgaataaagctgttgtcatccatgcctttgtgtgcattaaaataataactctcctattattgggctagtaacatgttcaaggctacaacaatatcagcatatacttctggaattctagctctcagggacctcatcaattctggttcctgaagagttccgtttttgaggtgaactatatattaaaatgtattatgttttaaatatgttatattaaatgtttattcaacatcactacattttatagggagagagtttatgcattagctgagtaagccgtttttgctggaatctgaaatctttaatttcctattgttagacactatattatttctagttcaatgtgaaaaagctgcactgaacatccttacatgtatattttttcacatatgtctaggtcttatggagaattcttatttttatctcttatggataaattcctggaaattattgtggaatcaaaagatagaaacaggccagatgtggtggttcatatctgtaatcctatcattttgggaggccgaggcaggaggatggcttgaggccaggagttcaaaaccagcctgggcaacatagtgagacctctgtctctaaaaaaagggggaagaaaaaggaagatgggaacacaagacaacatcttatagaaaaatgagtgaacacataggtcagtggaacagaatgaagagtctagaaagtgacccaccataagtacacccagcttatttttgtcataggtgaaaaagcaattcaatggaggaagaatgatattttcagtaaatcatgttggaaaattggttatccgtggaccaaaaataatcctaaatctaaatctcataccttatacaaagattaactgaaatggcagagatctaaatgtaaacagtaaatatataaaacttttataagaaaacacaggagaaaaccttcatgatttgagttaagcagagtttttagtcacaataccaaagcgtaagccataaaagaaaatatgataaatttgtctttattaaaaaatttaaacttttactctgtgagactattaagaggatgagaagacaagccactggctgtaagaaaaatttctacagatcacatatccaacatgaagcttgtaaccagaatatctgaataactctctaaactcaaaggtaagatagcaatcccattagaaaatggcaaaaaacttgatcagacacttaaacaaagaggatatgcggaggacaaataaatacataaaaatatgttcaacattattagccattagataaatgcaaactaaaaccatgataacagtatacatctaccagaatagctaaaatagaagacagtggcaacactaaatattgacaggatgtggaacatctggatctgccatatattgctggtagaaaagtaaaatggtacaatcctcagagaacaatgtggcagtttcttacaaatttataccgtatactttccgtaggagccaggaaacacaatcttggatgtttatcgtactgacttgaaaacatgtatgcacacaaacacctggacacaaatgttcatagcagctttgtttgtaatatcccctaaactgcaaatatcccaaatgtccttcaatgggtgaagtttatccaaagaaacttgttcattcatgtaatgggaatacttctcagtcatgaagagaaatgaattattgatacccacaaaaacttagatggatctctagagtattatgctgagtgaggaaacaaagtcaatcgcataaggttacatactctattccatttatataatactttcaaagtgacaaaattatggtgatagagaacagatcagtgctggtcaggggttacagttggtaacataaaccataaaggggtatgatgactgagttttttgtggtgatggaacacttctgtatcctgattgtgagggccattatatgaatctacagatgtgataaaatttcatagtagtacacacccaaaacacagatgagtccatgtgaaaactgtgaaattgaaataggtatgtagtttatagtattataataatattatacctatgtcaatttcctggtttcggtattttactatgactatgtaagatgttatcattaagaaaaagcaggtaaagcaatcatattaatgttctactatatttgcaacttcttgtttaattaaaaaaatggttaattttatgtaggaacacttaacatgagatctaccttcttaacagatttttaagtgtacaatacagtattgttacctataggctcaatgttgtacagcagatttctggaacttattcatcttgcataattgaaattttatacacatcggttagtaactcctccttctcccttcccatttcccctggcatccaccattctattttttgtttttatgagtttgactattttagataattcatataaatggaatcatgccatatttgtccatgactggcttatttcatttagcaacatgtctccaaagttcattcatgttgtcacgtactgcaggagtttttccttattaaaggctgaataatattccattgtatgtatataccacattttctttattcatccatttatggaaatttaggttgtttccacatcttggctagtgcaaatagtgctgccatgaacatgggaatgttaagatctcctcaagatcctgatttcaactctttataaataagttcccagaagtgggattactggcttatatggtagttctatttgaaattttttttgataatcttccttcctgttttctgtaatggctgcaccaatttacattcccaccaacagtgtacaagggttccaatttctccacatttttgccaacacttgtcttttgtttttctgataatagccatctttacaggtgcaaggttatatctcattgtgattttgatttgcatttccttgatagtgattttgaacacctcttcatatacctgttggccatttgtatgccttctttggagaaaagtttattcaagtgttcagcccattttaaaattaagttattcattttctttttcagttgtagtagttccttatatattttggaaattaaccccttattaaatgtatattttgaaaatattttctcccattcggtaagttgtcttttcattttgttgattgttttggctgtgcagaagctttttactttgttgtagtcccaaatgtctaattttgcaatttctcgcgagtctaaaattgttttaaggtaaaattttttttaaaggtatggacatttgtaaaactattgatgcacactgccagattagccttcaaaaagattgtgttcattttctcccatttaaatagttctctcagttgctttctatccatttatcctactttacattcttcacgtaagtatcaccctttgaaaccgtactgttatttattttgtctgtatgttcctttgtatttttttcctcagcttcattgagatacaactggtatgcaaaaactacgcataatttggaaagtttggacatatatatacactcatgttaccatcagcacaatctaattaacaaacatatccagcacgtacataagttttcttgagttccttttttggttactttttttttcttttttggatggtgagagcgtataacatgaactaccttctgagcacatgtttaagtatagggtactttattcgtaactataggcactatcttacagatcactggaactaattcatcttgtataactaactttatatgtgctgctgctttttgtttgttgtttgtgttggcgttgttgcttttgatgtagagtctccctctgtcacccaggcaagaatgcggtggtgcagcctcggcccactgcaacctccccctcccgggttcaagtgattcttctgcctcagcctcccaagtagctgggattacagatatgcaccaccatgcctgactaatttttgtatttttagtagagacggggtttcaccatgttgcccaggctggtcttgaacttctggcctcaagtgatccacctgcctcggcctcccaaagtgctaaaatttcagatgtgagccaccatgcccggcctgttttttatttatttatttttaatttgattactatctctttctttttcatgagggcagggatatggtggcattcggctccctattcttagtgacccacagcaatacctggcataaagttggtcataaatagttgtattttgaatgaaataatgaatgtaggtaaaatatttttgcgttactttcaatgttagagagattgaaacaactttgtatgtttattgaccatttgtagttttcctttgcccactaatgccatttgtcgctttttctctgttgggggtttattatttttttaaggaattatttatatataaaactatttatcctttacattttttcagatattcctctggcttcaattttgctttttagttcttttaattatttcttgtaacttttaaacatgaatattgtaaaattaaatttatgtcttttaaaaaatagtttctctgtttttatgattagaaagatcccctagacctaagataatatttttttctagaaattataaggctctatttaaaatgcaaattatccactcacaatttattttggggttaagtgaaggttaacttgtttttctgtaatagttcttctttagcacgtcattacagtatcttttttctttattgtttcagtttatgttagtataaccgattcttaaatatttatttcccctggaatttttatgctctttttctggtttgtatattcccctaatattactacagtattttaactactctagagcacattatgatatctggttaggcaaatccttcttttaaaatgtttcttttctttcttattcctactttttattggtcaaagtgaacatcttacaaagtttgaagtaaaagtccctggctttttgatgttacatttgatttagagaatactttggctatagctggcatcttcaacgtatttagtctttctaaccgacaacgtaatttgtcttttttcaatttatttaagcgttctttatggcctttagtcaagttttatagttttcttcctatggaccctgcacattttttatccagtttactctggggtactttatgctttattgttaaatctgaagacaatctatttttgattttaccttctcactagattttctgctctttgtattttatttgtatatttattatgaaactaacttccttactaatattttaataattcaagtatttttcaatttttattgttactgttataggacaagcaattctatcattgttaatcaatgataatgttggaatacagtaaggaatacttttctatatttataacctattcatttctctggtcttctatcttgagtaatgttaaataaaagtaatgagaatcatcatattgctcatattcctgactcgagtgggaaaacatgtattgctttaccagttagcattgtgccatcaatatgagaaatatataaaccatcatgtttaaaatctgctcgtgtatttctaatttaaccagcttttgggatttttgttgtttaatttttggaacataaatgaacttacatttcatcaattgccttttaaactgcctactgaattattatttattttatctgacattgtgatgtgatccatagcctttccaatattgaagcacattacaagaaggcaatgacatgtaacggtattttttttaaaacatgttgctggattcagtttgtaaatatctttgaagaatttcttcagctacgttcattagggatgttcattaactcattttgttcatatttgttaggttttctattaagctaatttttgtgcctaaaaggtttggcaaaacttcccccaacctccccttagccattggtcattgtgcaaatttgggtccttccaccaccctacttgctttcctccaaatacattctaaattgtctggtccttatactccatggcagcggcttggaattgaaatcttggatgttatggcaatgtgaccaagaatcgggccattgcttccaggcttccaggctttaaattatatatatgtacacacacacacatacatacatatactgataatggctaagatgacacaagctatatatatatatatatatatatatatatatatatatatatatacacacacacacacacgcacacacacacacacacacacacatatatatatatatatatatacacatatatatatataatgataatggctaagatgacacgtagctacataatggtgttgacttttgttggtcttgcaatcatcaaaaacccctagtctttctcagaaacttctgcttagccagctgaaaagttttctgggtggtttgttgaatccactgacagtccttcatatcagttcctcaaatttcatctcattatattcagaccattatcttagcctatgttcattctttgtgaatcctcactgtcatccagtgaagctactgtccttagtttcatgccattcacaaacggaacatttacttgctataccttcctcctcaccactgattaaaccgtagttttgaataggcataagtcagggcctctagctagacactaaaatctccattcagacaggtgtatataatcattaatcatttggtaagatcattcaaatcattacggattggagtttgttctttcgttaaataataattgaacacttgtgcttagccaggcaccatggtagctattagggatacaacaactaataaaatgtgttcagagaaaccagacaagtaaagaagatgaatctaatatggtattcattatgatagagaaatgtgaaaagctttcaaatctcaagaaagagctaaggcagaaaggagtaaatagttattttttaaaatttcattgatccaggtatatctggtctgtggtgggtgctgtgatgtacaactaagattctggtttagaaatcaaaaactaatacccgcagcagctgagagtgctgcctgcagaaagtccacagctgtcatctccttacaaagatgcctctgctgaagagagctagtttgtccaaggtagagcctcctttccaggcggcctacatccaatgaccaattgatgggaaaatgtaagggcctggcccccttgccagtttgtaaaaattctgaagggtcattctagtttcagaattcccagtaaggtcatcgaggctttcccttgaggctgccttgcagtccaacttctctttgcccactgttgctttcttcccttctatttccttccacagatattgattcccaaaggcactctctagtaaaccctttgcatgctaatctctgtcttagaatctatttttttgggcaccccacttgtgacatggttatactgattattttggtcttcacagaccttactccttcttgtctatttctggtttgatttaggatcacaggtgggtatgtgatggtggtgttattttgtttgaatttttaaaattcaactcaagatttcttattgttatagaccttgtaactaaaccacttaaaacgttttatacttccaacaatacattaataaatgtgttctagattaattattgcagcattgtttgcaactgcacatatgggaaatgactgaatgctcatttatgggagatggctgaatgagctatgtgtagcacatctgcactatggagtactatgaagctgtagaaaagaatgaagattttaagtgttctcaccacaaataaagaataagtatgtcaggtaatgcatatgttaattggcttgatttaattatgccacaatgtatacatatttccaaacatcatgttatatgctgtaaatatatagttttgtcaattaaaaatcaaatactaatataaaaagtgtttttaatataacaaagaagaattagtaaaaaaaaatgagaaatcatcagacagacataagttggggatcattttacaaaacaactggtctatactgggaggagctcttccatgtagaatgactaaagagttatgaccgctaaatgcagtggtgatcctagacaacttctggaccataaagaatgctattagtacagtcgataataattgaatatgcatgatatatagagataatatttcattaaactgtcagaatttattatagtacttttcagagaatgttctttttcttcggatatacatgctaaggtatttaggagtaaagggttatgttcctggcaaataattaaactcaataactcagcaaaactaataataatactattcatgacattataaaatatttaatacatatagtacatttataatattacaaaatatggtatttaaatatagtatattatttataatgtgaaatatggtgtttattactttattatatgatatatagagagagtgagtgagagacaagggggaacaaatgtagccaaatattaatgattaataaatatagctgaattatatttgaaaattcatcatcttactcttgcaacatttatgtaaatttgaagttgttttcaaaataaaaattaaaagaaaacgcttcagtaatacatatttatatgtaatttaatatttaaaatgctttttccataaatttttccagtgctttttgaagcacaacagaacactatgcctgagacttaatatattctgcaataattggcacatactccgtgtctctaaagaactagaaaaataatttgcactcaatatatactaactgactaaattttgtggctcatgaataacattcttggaatatgtgctcaactaagggttattcctcaagcctatgagcataacatgtgtcaaactttaaaaaaatacacctttctccaaattggggaacttactttgatcagtaattttacttttattacattttttaaattagtgatgaatgattagagaagcttttagttggcgttgaccataattatttttaaattaaatttacagaataaatttcagataaatttgaaagataacatagatttctaaaaaattaattttatcttcattaaccaagatgcctaaaagacctagattaattaaatatgatttccttaccatctacagaatccttttcaaaatactctgaagtgtacttgcagcaggataagtgtctttttatcctgttgatcaaaattttaaaatatacttagatactgatgactaatggaaaaaactggaactccttgttggggaaaaatgctgctgcatagaatttgacagcaaaatcacaagaatagataatcatacataaagtatcttagatagattttacaaatatgctttcttgggattacaattccaagaatatgaaatagatctgctttttcctcttcctcctattaaattcaactaaaaaccctaaatatgatctataaaacaaacataccaagaatctaaaagaatgaaaggaggatgatcttctgggaatctcacaacctcaggaatggcatagtagtgagttcctttgcttttctttttaacttatataccccagagttggagctgaaaaagctggcaaccctgaaacaccaatgggtacagacaaaaaaacataccaggttggattattcccatagcctgactcataactgatttagattatttatatgatgaaatattgaacttttaagctgagaaaacttagatgaaattttgaacttgagttgatgctataatgagttgagatttttagaaaccttgaactagggtaaatgcattttgcacgctgatggacatgcatttttgttggccggagggtagactgtggtagataaaataatgaccccacaaagatgtccatgttctaatgcccagaacctgttaatatgtcaccttacatgcaaaagggacttgcagaggtggttaaattaagaagtttgagatgagaatgttctggactttctgggtaggcccaatataatcacaatgggtccttagaagggaattagaagaaaaccatgaaatcaaaaacagaaaatcaatagataaaataaaggaaacaaaatggaagtttttgagaaatataaaatttacaaacatctaacaagggtagcaaagaaaaaaatagagaaggcataaattgccaatatcaggagtgataccaggtagcactatagactgaaaacatcaaaaggattgcaaaggaatactacagataagtatacagacataaatttggcaaattacacagaatagacctctttctcaaaaaacacaaactgtcacaactaataaggaaacagaactggtagtcaaataacttaccacaaagagaatccgaggactgtatggctttaatgaagaatcctaccttgcatttaaagaagaattaacaacaattctttacaatcgatttccaaaaacagaaaagtaggaaacactttacaattaattttatgaaactaatactgctctgacaacaaaacaagacaagcgcagtaccaaaatatcactacagaccaatatccctcattactgtagacataaaaattcttaacaaaatatcagtgaatagaattcaaagtgtataaagagaattataccgtataaccaagtgggatttattccagagatgcaacgctggttcagtattcaaaaatcaataatgtcatttaggctaaagaagaaaaatcgcatgattatatcaatatagatagaacatttgacaaaagtcaacacttgtttatgatttaaaacgctctcaacaaactaggaatagagaactttctcaacttgttagtgagcatctaccaaaaccctgcatctaacattgtacttgatgccaaagactacaggcttttctcttaagattggtataaaggcaagtttgttcattatcacccttttgttcaacagagtggtgaaagttctagccagtgcaacaaggcatgaaatggcaataaaaggcataaagatatgaaatgaattaataaatacaatgatttacgtttgcagatgacatgcttgtctacatagaaaatcgctgaaacttactagaaccaataaatgagttcagcaatgtcacaggatacaagataaacatacaaatgtcaattccatttctatatactagcaatgaacacttggacattgaaattaaaaatataatactatgtgtaagtaccccaaaaagaaatactttagtgaaaatgtaacaaaacatttacaggacttgatgcttaaaattacacaatgctgattaaggaaataaaaaatctaaataaatggagagacatgtcaattctctccaaattaatacatagattgaatgcaatgtctatgaaaatacaggaagctttattgtaaaaataggcaacattattctaaaatgtatctgggaaggcaaagtactataatagctaaaaccattttgaaaaagaataatattgtaagaggaatcagtctatgctatttaaagactatattgctacaataatcaagattatgtggtatagatcacatagatcaatggaacataagaattcagaaatagaccaacacatatatgccaagctgtttttaaaaaatttattttattttgttttattagatattgaaaagttatagttatattttcagtggaggaaagatagccttttaaacaaatggtactggagcaattggttgtccataagtttcataccttatagaaaaattaactcaaaattgagcacagacttaattataacacaaaaacaaaacaaaactatcaaacctctggaaaataatcataggtaataataatcaggatctaaggctaagaaaagtattatttgactgggtaccaaaaggataattcataaaaggaaaaactgacaaatcataatttatacaaattaaagttttagctttgtgcaatactctgttaatatgatgaaaaggtaagttacaaagtgggagaaaacatttgaaaatcacatatctgacaaaggactgtatgtagaatatataaagaactcacaaaactcaacagtaaagaagcaaacaatccaatgagaacatgaggaaaacacacgacacttttcaccaaagaaggtatacacatggcaaataaccatataaaaagatgttgaacatttgcatccattagggaaatgtaaactaaaaccacaataaaatattattacacagctatgagaatggctaaaacttaaaaaatatatagtcatagcaccaaatgctggcaaagatgtggagaaattggatcactcatgcattgatggtgggaatgtgaaatgctataactactctagaaaacgtttagaattttcttgaagaactgaaattgtaactatcatatggcccagcaattgcactcctggcatttatcccaaagaaatgaagacttagtttacacaaaaacctgtagtggaatatttatagtggccttatttatagtagacaagaataacctagatgtttttgcatgggtgaatgcttaaataaacaggggtacgttcataccaaggaatgatgttcagcaataaaaaggaacaaactattgatctatggaggaatgtgcctgtttccacaatttgaagaattttgctgagtgaaaaaagacaatcctgaaaggttatatactgcacaattatatgtatataacattgttgacatgacaaattagagagacgaagaacagattagtgatttccagggcttaaggaggtaccggaggtgggaggaaagtgagcatggctatactacagaagggctacaggagggatccttgtcgtgatggaaatgttctgtatcttgactatatcaatgtcaatatcctggttgtgatattgtgttgtagttttgaaagatgttgcaatggataaaagagttaataatacacaaagtatctccatgttacgcttttaacttttaagttcagggttacaagtacagctttgttacacaggtaaacttgtgtcatgggggtttgttgtacagattatttcatcacccaggtattaagcctagtacccattagttatttttcctgaacacttgcatgtgactctacaatgctttcaaaatgaaatatttaattaaaaataatattctctttttttctgctttctgtagctggtataaaagattctgaaaaatcctcccaaaagttggagacaaggtttaaaaaaatgtaagaagaggacacaagaaagtgttataagacccactaccctctaccctgtcataaaaaattgtagaggactttgaaattggggaaaataattcagtgaatgtcctttctagagcaccctacatggttatatcagtctttcatttactttgagctttttttcaacattataaagtgtagaaagctaataataaggcaaataatgcatgtccatagaaatgcaaattgtacattgaggaatgcaattgattactgctctgtgattactgatcaattatgtatcaattaagcaaattcgtttcatcattcttggttggtatatgctgtggtccgaatgttcgtgtctcttccaaattcatatatggaaatcttaaccctcaaggtgatggtattagaaggtgggatctttgggaggtgattaggtcatgagggcagagcccccataatggctgttaccatccttataaagttggcccacgggtgttcatgggaggatgcagcaagaagttaccgtttttgaaccaggaagagtgccgtcagcagactccaaatgtactggtaccttgatgttgaaattcccagcccccagatctgtgagaaataaatatctgttgtttataagctacccaatttatgatattttgttatggcagcccaaatgaatggaaacagcatacatatttgtctttttttggattttgctttgaactggttgtaccgtcttactgattccctcattaactaaagagttaaatacaatctttgacacatatttaccccatgtttgtatgagaatcatgattatacccttctttaaaatttatgttttattaatgctaggagtttttatcaatttatccataaaaatattggggaatactcaagtccaaaataaatgtctaaagcccatactcaaggtttggccatgtcataacaaatgtaaccaaaccaattacagtgaaactgtaccagcttaaggatatatatgagtcactgtggcagaatacatgccctgaattccaagatattggatagaagccacttatatcttgagattgttcctaagaagaaatctatttttcacatttttgttattaatggcaaggaatgaaagggaacttctatatttatactgtgaaatatgcaaggatgtggaattgtctggtgggaagccttagcatggagcttggtcatcaaaagaggtattgtaggacctgcagtggcaagtgggccttgaaaagggagctttatagcatgaaacaaaaagaactaaaagaataaatgtagctgctttagcttcaattgatatgtcaaagttgtgggtcgaggcttgataagaaatgaagttgctatgttggaatcaaggggaagaaataaacaagggggaccggtgttttgtagcaaaaaaggagaggcgtttatatgagaatggtaatgatcaactttaggatggctgtaattaggtgtccagcttctgtagttaattttaattataaccttctggcatcatggttttgtcaaggggaaaatactttgagggagtacagtgcattgaatcctgtgactgttacatgtcaggataggcaggtggtcctcaagaaaagaaaatggttttttcaaaagcaagtagcctgtgtatctatcacttctagggaaaaagttgatcatagaatcctatctgtcttctagagaaatgtatgcctagagtggagaaaggtagccctgcactcaagttaaatcatagcttcctctccttccatttgtcttatttctagtcagaccaagcaaactgaaagttgtttcttgaatggtacttagagagggcactgagcaagtaaatgcccattttcagttatcttttcaactatgatttattcattgtaaataaaaatgggatatatggctcataatcagttttctataacttaggttggtcaacattttatataatcaagattctagacttagaaatctgaagataagctcctgaatttgtgtgctttcttcaaggccctgtgccggatccctgtctaatgtctatggtgggcttttttttctttaatatgcctttataaaaacaccacatttaacaacttttgcatttatatgacttacacagcatagcttcatctttgcgttaaaagtcatttcccatgtctatataatttcttccctgaaagtattctttttggaagtgcctaaatgtttaattgcatgtgacttttttttcattgtgaaaataagccttgccccatatactctaagaacctaaaagaaacttgggagaagtccttaaaatgtttctattacagttttctactcctcttcttaagaaatctttttaaatgcatagggaaatgttagtgctgcaggcttattttcatagtagtagtaggaagaatgagaaatgggtccctaaataccattgtccaagttcctgatgaaaagagatgggaatgttattcagataattcatacagaatagatgcaatctatttaaatcccttctttgcaagtagagaggctagaaatccttcagagaattgacaactcaaggtagaaactggttggggacacgtgaagccagagaacaagctttgctttcatacctggtaatgaaacttcacctaatgaagtaacttaggtaaaagtggtgctaaagcattttcttttcagtttttcacatttttgggaaaactaatgtcttagtttaggaagtcaaataatttttactagaagcaaatgtttgcggcccatctattcctcttctgttacaatggagtttttcttctgcgaatagcaatccttgcatgtgtactctaacctttttcccttctcaaagtcatgattccatcagctctccattttctctcctgcaacttcaaactcatgttctctattggatctttccaccaccaatcaaacatactctagactctcccattattgaagaaaatggggtcataaagcaaatcaacccaaataatatggtcaatttattagatgtacatgttgtcttagtggggttttatttatttttctccttactccagtcaagtttctgtccacacacttaactacaatgacttttttaaggtcacaataccctgcacctgattagatctgataaacatggttgaattcactcttcatttgacttgtcaggagtatagatcaattggcctcctcctccttcataaaaacattatcttcccttaacttttgtgacatcatagtctgttttttccctacctctctggctacctctttatctctttgtgggctactgtcttcttcaagcaaacttgaaatactggctgttctcaggtctcagtcttgactctctctctaagaatcaagtcccgtatctttaaatatcttctatattctgatagctgtcaaacaaattaatttctgaagtctaagccaatgtatccaactgactacttgacatctttatttggctatctcataggtatctaaacatccacaaaactgcacttcttattctcacttctagccaatcaatctgcttcttctctactctcccccatatctgtaaattgtactagtgtctcctcatttttggagtccaaaaatccaaaagccattcttgaagcaacttgtttttcccctttccccatttaatttatcctcatgttctgttgctgctacttccaaattatggctcaaattcaatctctccactcccatcgtatctctcttgaaccagtacagtagtgtcttattttctctccccaaatccaattttctccccaaagcttgtcttgttcctctcaaattaactccccatagaatggcaatgatttttttaaattgcaaatgtgatagtttcattcttctgtttaaattcttcagtgtatatccattatccttagaacaaagaacataatcctccaaatgacttacaatgcatgacctgtctctttcatacttctctatttcatccttcattatgctgcagctacactgatcttctaggtttcttcctgccctacaggtcctttgcacattctgctctctatccttagcacacctctcacaccactcttttcttgagtaactcttcactgatccttcaggttcaagcttaaatgccactttctcaagaaggatttcttttagtcctcatgctagattagtttgctgtggtatacactctcataaaactctctgttttagcattcaatgcttggtgttgtttataagtatgaaccctaaagagaaagtccctaagttcaggaaccatgactgttggttcagtaccatatctgcttcaccttgcacagttcccggtaggtactcaaatatattttctaaatgaaatcttagttttgagcgtgggtggatccagaaaagagagattaaatgtattgctcggatctaataaaatatgtgtgaacagactgatgtctctaacactgagaaaaaaaatcactcaggaataatggaataattagatgaagtctatttatttaaatttaattttccttttaggcaagatgtatttttttctgatctgaaaaataatgcctaaaagcctcaaatccagctagtcataaaataatgaatgttaaactgtagctctgactcaacaagacatgactgtacataatcagtaattagcatgctattcattactgtagagtttgtgatacattgagatggggcgggctgaaatggccctgatcattaagaataaattatttctgtaaataagatttcaactgaaatgtttgaaacacatagagtacctaccctgttttcaaataaacactatgtactatatatactatacaaaatggctgccttagttgcatatcatcatgcttattgttaaaagttaaaatgcacacaagttcagaaaagaaaataatgatccattctttaatcaagagaaaattatttacagtttgctaaacttcttttcaattgcatgtattgtgtgtgtgcacatgcaaatgtatatacgcgtgtatgtctaagaatccagtgtttctcaaacctgcatgcacattggaataacctgggcagcttttaaaacttaccaaaggacagagctcatttcagaccaatttcatgtgaatttccatgggtatcatccccagagctttatgctttttaagttcttaggttgatactaatgctacactgggctggacattgcttcttgttgttttgttatttgttttttttaaagtagaatcacagatgtattcacttaggtgcactacattgtatttaactatatctctattgttttaaaaatattttaataattatttgaaaattatgagcatatattatatgataacatgacgtgatttccttaggtcatattcctaaaagtgaaattgtttagcattaggtacaaacctgcatgttgtgcacacgtaccctaaaacttaaagtatagtaacaataaaataaaaaaaaaaagtgaaattgttattttttaaaggcgtaattttgataagtttctcatcaaaagaaccttatcaaaaggcataattttctaaatattttcaaattatttatttaaaaagtgtaccaatttaactcttaaaaggaatatacaaaaatgttcatttaattttaccagtaccaacgttgtatattattttaaataaaagaggctaatttttaattcaaaactaataaatatatgtatgtatgtgtacaatgtcatgttttgatacaggtatacattacggagtgattaagttaagccaattaacatatccatcacctcatatacttatcatttttttgtggtaagaacatttaaagtctactgttttagtgattttgaaatatgcaataaatcatgattaattatagtcacaattctgggcaatagatcactaaaactttttcttcctgtctaaaatgttgtaccctgtgaccaacatctccccgtttctcatcctccctcccaaacccccaacccccacacagcctttggtaaccaccattgtactctctattcctatgagttgggcttttttacatttcacatgtgaatgacatcatgcagtatttgtctttttgtgcctggcttatttcacttggcataatgtcctccaggttcatacctgttgttacaactaacaggatttccttctttttataaagactaagtagtattccattgtatatatatgctatattttccttatccatgcatccagtgatgaacacttgggttgagtcctatcttggataatgtgaataatgctgaaatgaacacaggagtgcaaatatatctttaacacactgacttaatatcctttggatatatatccaaaagtgagactgctggattacatgataattttatttttagttttttggggaacctccatactgttttccataatggttgtactaatttacattcccaccaacagtgtgcaagggtccccttttctctgcatccttaccaacaccgattatctttcatctttttgataacagccatcctaacaagagagaggtgatatatttcattgtagttctaatttgcatttccctgatggttactgatgttgagcatctttgcatataccagttggccatttgtacgtctttcttcacaaatacgtagttgggtactttgctcattttaaaaatcacattttttgttttcttattattgatttttctgagttacttatacgttttgcatattaattccttatcagttgtatggcttgaaaatgtattcaatcattttgtagtttgcgtctttgttgtttcctttgctgttcagaagctttttagtttgatgtaatcccacttgtctatttttgcttttgttgcctgtgctattggagttatatccaggaaatatttactcagaataatgtaatagagcatttcttctatattttcttcaagtagatttatagtttcaagtctaatgtataagtatttaatccattttgagttgatatttgtacatggtgtgagatgagggtcccattttattctcctgtgtgtggatatgtaattttctctaacattttttgaaatgttttcattgtgggtccattttaagcttcctattcaatttttaaaattctgagttctaaaatttttctcattttattttttatttaaaaatatttaattgacaaagactgtatatattcaaggtgtacaacatgctgatttgatatacatatacattgtataacaattatcacaatcaaattaacagtgcacagcacgggaggtgatgaatgtgttcactaattttttttttttttgagatggagtcttgctctgtcgcccaggctggagtgcggtggcacgatcttggctcaatgaaacctccgcctcctgggttcaagcgattctcctgctttagcctcctgagtagctgggatttcaggtgtgtgccaccatgcccaactaatttttttgtatttttagtagagacaggtttcaccatgttggtcaggttggtctcaaactcctgaccttgtgatccgcccgccctggcctcccaaagtgctgggattacaggcgtgagccaccgcgcccagccaaattttttgttattttaaatgcatttcctttgtgtacatatgtgtagcaagatgtatcatccctagagaaaatcgcataaaatatataacaacaataactactataatttaacatatcatgacataacacagcatgacatgacataacaattataaagatcacacattttttataatatcacagcacaagataagactaccataccaccagtaccccagaagccatgtgccttttctcaatttcatcaactcactgcctccacccagagataactgcaattctgagttttgtgacaatgccatatttgcttttctttatcgttttatttgtaaatacctagtttagttttatttgttttggaaatttatgtgaaatgagtcatactacagttatattttttcatgtcttgttttttgtctgctcaattttatgtttctgagatttatccaggttgttgcatgtactgtgtaggtcctttattttcattgctgtgtgggatccagttgtataaataaaccataattgacttgtttattttcctgatgatgggcataattatggatatgttcatgagcctgaacaatactatggacattcttgcagatatatttgggtgcatatgtacacacatttcagtctggttacacctaagattggaatggctcggttgtacaataggcacatctatcactttattaaataatgccaaactgatgtctgagatagttgaacaatttatactcatatcagcactgtatgtgtgttcgtatttctctgcattttcaccagcttttaccagttgtcaaactgtcaaattttttccaatccgaagtctgtttagtggttcctcattgcagttgcaattttcttctctttgattaaaaatgagattgagctgctttttaacatgtttatttccatttgtatatattcttagaagtatcttctaaattgtttgcccattcttctattgtatttctgtcttggtgtctcacgattttttaaaatttattttgtattttttaattgacaagtaaaaattatgtatatttacggtatacaccatgccactttagaatggctaaatcaagctacataacataagcattacctcacaaacatcatttttatgtggtgaaagcacttaaaatctaccctgttaacaattttcaagtatagaatatattgttattaattgtagccactatgtggtacaatacatgtcttggatttatttctcccatctaattgaaattttgtatcctttgaccaacatgtcctcaatctccccgcgccccctccaggctatggtaactaccattaaactttctttttctatgagtttgaatctttcgtgttccacatataagtgagatcatgtggtatttgtctttctgtgcttgcttatttcactaagcataatgctctccagattcatccatgttgtcacaaatcacagaatttttttctatttaaaagtggaatgatattccattgtgtatatgtatcacattttctttatccattcatccactgatgcatacttaggttgtttacgtatctcggctattgtgagtaatgctgcagtgaacatgggaataaagatatctcgtcagtatattgaatatatacccagtagtgagattgcaggattatatttttcttctaatttcagtttttttgaggaaccttcatgctggttttttatgactctaagttacatttccacctatagcgcacaaaaagggtttccttttctccacgtcctcaccaacacttatttttcacatatttttataatagcccttctaataggaataagatgatgtatctcattgtggttttagtttgtgtttccctgatgattagtgatgtagaacaccatttcatacagccattggacatttgcatgtcttctttagaaaaatatctattcagttactttacctgtttttaattgggttatttccttataattgagttaagttccttatacgttttggatattagcttcttaccagaggtatagtttgtaaacatattttcccattacatatgttgtctcttcccattccatacattattgattgttccctttgctgtgcagaagctttttagtttgatgtaatcctgtttgtctatttttgcttttgtagcctgtgctttcggggtcatgtaaaaaaatctttgcccaggccaatgtcatggagcttttcacttatgttttcttgtactagttttacagcttcaggtcttacatttaagtctttaatgaatttgagtttatttttgcatacggtgtgagatgagggtctaatttcattatgctgcatatggatatctagttttcccaatgccctttattaaatagactgtcctttcctcattgtttctccttggcgtctttattgaaaatcaattgacagtaaatgtgtagatttattcctgggctccgtattctgttttataggtctatgtgtctgtttttaggccagtaccatgctgtttcaattaccatatccttgtagattttaaaatcaggtaatgtgatgcctccagctttgttcttttaactgaagattgctttggcttttctgggtttttcgtggttccgtataaactttaggattttttttcgatttccttgaaatatgacatcggaattttgatgaagattgcattgaatttgtagattgctttggtagtataaacatttcaacaatattgattcttccagtctgtgaacatggaatgtctttccatttatttgtgccctcttccatttatttcttcaatattttatagtttccagtgtacagatctttcacttccttggttaaattgattcctaagtattgtattttatttgtagctattataaatggaattgttttcttgatttattttttagatagttcattgttagtgcatacaaatgctactgattttcatatgttgactttgtaccttgcatctttactgaatttctttattagttctaagtgttcttttttgttggagtcttcattgttttctaagaataagttaatgtcatctgcaagcaaacagagacaaataacttcttcctttctgacttagatgtcttttatttctttctcttgcctaactcctctggctaggacatccagtactacattgaataaaaattgcaagagtggacatccttgtcttgttcctcaccttaggagaaaagttttcaatgtggcattgttgcataagatgttagctgttggctcattgtaactttgttgaggcgctttcctcttatgcctaattttttcagagtttgtagtatgttacattttgttaaatgcctttcctccatctattgacgtaattatatggtttttgtccttcattctattaatgtggtgtatcacattgattgatttgcatatgttgaaccatccttgaatccaaggtataaatcccacttgatgatggtgaattattcttttaatatgtttttgaatttagtttgctaatatttttgaggatttttatgtctatggtcattcttgtagtatctttgtttggctttcttctcaaggtaatgctggccttgtaaaaagtgtttggaaattttacctccttttcattttttgttttctgaagagtttaagaagcattggtattagttcttctttaaacgtttgctagagtttagcagctcagccatcatgtccttggcttttctttgatgtgagatctttgataactgtttcaaactctctgcttattattcatttgtttatattttctatttttccatgattcagtcttctgtggtcatgaaaggtacttgatatgatctcaatcttcttaaatttgttaagacttgttttttagcctaacatatgaattatcctgaagaatgttctgtgtacactggatgaagatatgtattctcctgctcttggatgggatgttctgtgtacacttgatgaagatatacattcttctgctcttggatgggatgttagggtcatctgtccccaaagtataattcaagtccattgttattgtgttgattttatttccagataatctgtccattgctaaaagtagggtgctgaagttctctactgttattatattagtgtatctctcttcagatctattaatatttgtcttttttttgagacggagtcttgccctgtcgcccaggctggagtgcagtgctgcgatctcggctcactgaaagctctgcctcctgggttcatgcgattctcctgcctcagcctcctgagtagctgggactacaggcacccaccaccacacccggctgattttttgtatttttggtagagacggggtttcaccgtgttagccaggatggtctcaatctcctgacctcgtgatccgcccgcctcggcctcccaaagtgctgggattacagccgtgagccaccgtgcccggccaatatttgttttatttattgctttatatatttagttgccccagtgtttggtgtatatacatttacagttgttatatattcttgataaattgatctctttatcattatataatgacctttgtcttgctttatggctttctacttaaggtctattttatcagatgtgagtagagctacctttgctctcttttgatttccatttgtgtgaaatatctttttttgtatgtttacttgcagtctctgtgtgttcctgctagtaaaatgagtctcttttagatagcatatagttggggcttatttttttttttttttatcttttgaaccactctatatcttttgattggactatttaatctatttacattcaaggtaattattgataggtaaaaacttactattgccattttcttaattattactggttgttttgtagatcttgtgtttcttcttctcttgctgtctttctttgtgattagatgattatgcttttatttctcactttttatcttttgtatatgtacgatagtttttgctttgtagttgccatgagacttacgtaaaacactttatattgtaacaggctattttaaggtgataacaagctaattttgatctcataaaataactctacacttttacttctcctcccccacattttctgtttttgatataacaatttacatcttttatattgtgtattctttcacaaattaatgcagctattactatttttaatagttttgtattttaaccttcatactaaaaacataagtgatttacatgccaccattacagtattagagtattctgtatttgactatgttgttacttttaccagtgagttttataatttcatgttttcatgttactaattattgtccttttcttttagcttgaagaattccctttagcatctcttacaggtcaagtcttgtggtgatgaactttcttagcttttgattgtctgggaaagtcttaactctccttcatttatgaagaacagtttagccaaatagtcatcttggttggcagttctttgccttcagcatgttgaatatgtcatcccattttctcatggtctgtaaggtttctgattagtaatctgctgccagcgttattgtgatttacttcttatttgtgatttacttcttttctcttgccttttttaggattctctctttgtctttgatttttgatcacttgattataaaatgtcttggtgtagtcttctttggattaaatctgaatggagaccgttgctcttcctttacctgcaaatgcatatctttcccgagattttgaaagttttctgctattatttttaaaaataagttctctactcttttatctccctcttctcctttttgaactcttataacttgaacctttgctcttttcatgctgttccataaatcccacaagctttcttcattccttttcattcttttgtttcttttttcttctctgactatatattttcaaataaccatctgtttcaaagaggctcaacagaggccactttttgggagaggaaagtgcaactgtatctcccttttgtgtgtttcccagcaggtatggctattggttacctaaatagcaagagatgcaggtgttctctgcagtgcaggcctctggggatcatagtggctttcaccaagtgactgatatcaatagcctccacctttgtttttgctcctagccatctcctggcatcttgggtatgccattgtttgttttttccttttttttccacaaagtctcactctgttgcccaggctggagtgcagtgtgtgatcttggctcactgcaacctccacctcctcagttcaagcgattctcctgcctcagcctcctgagtagctgggaatacaggcgcccacgccacgcccaactaatttttgtatttttagtagagacggggtttcgccatgttggccaggctggtcttgaactcctggcctcaagtgatttgcccgcctcggcctcccaaagtgctgggattacaagcctgagccactgtgcccaaatgtgtatgccaatttcaccagcaatcctttgtatgtggtggacgtcctccctgtttctttgtttcactgtgttgctgcagattctttaatgagcccttgagtcctctctgggctattttttgtttgtggatcttgttgagtgtgtgtgtgtatgagaaagagagagagaaagagagagagcgtgcgtgtgtgtgtgtgtgtgtgtgtgtgtgtgtgtgtgtatgtacttatacatacatgtattttgtgaggtgatgaagactggtgtctcctactccaccatattagtgatgtcaccctatcataaagtttttaacattttctggatactagtccattttcaattatttatattttctttctgagtaaattttaatcaattatcaattttatctgtttttgtaatatacctttcaaatctctactgtatttgtaattgtaccactttttaattcttagcattatttttttctagactagttaagcctaaggttttaaaatttctgttagtcttttcaaagtgctaccttgggtttttattaatcttcactattgaatgctattgttctattttatcagttttatttttatattttttatttcatttcttcttttgttatttggctcattttgctatcatttaaagaaattatttcaagggtgtttttattgtcagattttctttatttcaatacagtagacaagatatttaagcctataaatatttctctgatattcatcttactatactctacaatattaattttccattttaatcactgaccacatctaaatatttaatattttctatcatgattttttctttgctccaagtgtgtagaagtgacttttttaaatgtcccaaatatttttaaaaatcatatttatattttcaatttctgatttttaaattttatttttattgtatatatttaagttgtacaacatgatattttgatataagtatacaatgtttgaataaatgtgatcagttgtggaaagatgtaggaaaacattggaaatgagagaaaaagaggaaaaaatgaacagagttaaagaattaagaagggaaaatgaagatactgaaccaatgtcctcagactcctgaagtcacagattggttgaaattatcttcaaggtgcattattttctcaaaagttataattttttaggtgatatggtctggctcttagtccccattcaaatctcatcttgaattgtaatccaaattgtaatacccgtgtgttgggggaggggccttgtgggaggtgattagatcatgggggtggttccccaattctgttctcatgatagtgagtgagttctcatgagatctgatggttttagaagcatctagcgtttcccctgctggcactcagttttctctcctgtcatcatctaaagaaggatacgtttgcttccctttccaccatgattgtaagtttcctgaggcctcccaagccctgtggaactgtcagtcgattaaacctctttacttctttactttataaattacccagtcttgtgcagttctttatggcagcatgagaacagactaatacactagttgttcataacacaaactttaggtgcagttcctgataatgttaaagtttgcataatttgcctgtttctgggcaatcatgtatctctaaggctgtgaaaaagccctgtaagtgaaaaaaaaaaaaaaaaaacagaaacccagaaccaaaaccaaaaccaaaaccaagccttgtaaatcaaatgagtttttctaatgtatttcagaggtaccattataaatcaatgctttttggctgcagagcaaaactatttaaatttaaaaaaatacttaaaagtttgtaatatttgtcatgtttatttaccttggcatttacatcttttgtcctatttccaaaaaatcttcatttatgatagctgtttttggtaggaatctatggaaatggataatagaaaaaaaaagattaatagaggcatattataaagcttattgaattatggaataaaagccattaaaattgctttaaagtaaaatctaatactatgtaattcaattcagtactaacaactttaaaaaatacaaacaagcgtaaagatataaaatctggatggaataataatagatctaatattatttagatatttatctctctcctacagatagaaaggtattcattaaactgttaattttgaatttgttgtagatatgcatggagttgtgggaaataatactcagaggccttatgtgatctttaccctgtttaggtatatttttaattttcaagttggttgcataaactattcattagtcaacagatactggacaaaatctaccattggactgacattttttctgtttttggtagaaaaataaaatgccaaaatatatgaaatactaacaacaaatacacaaatagaatatgtattcttctatcgttggttagagagttttaaagacatcacttaattagagttggtaggtaatttgggagttctggtgttaggtgcatacacatttaggattgataattcttgatggatgggctcctttgtcactacttaatttccctctttattcctggtcacattcattgttctgatcccaggaatacaaagttgaattaacatttggaaataaatcaatataaccaccatactgccaaatacagcagaaaacccatataagcacacaaaacgtgcagagaaaaaatgtgataaaattcaatggacatttgtgatttaaagaaacaaaacaaacaaaactgtctgcaaactaggaatagaaagaaatgtctccaagctggtaagcatcatctatggaaagcccacagctaacataatacttaatggtaaaagattgaatgatttttcccctaggatagagagtaaggtatggatatctactttcaccattactatttaatgttgtattagagatctcagcctcaatgatgaggcaataaaaagaaatgtaaaaacctaatgattagaaatgcaagaaagctgtcactatttatagatgacatgattatatatatatatatatatatatatatatataaaacactgtagaatattcaaaaaatggaaccagtatgttaatttagtaaaataacaagatataagctcattatatgcaaaaggccattgtatttctatgtgctataaacaaatatttggaaagttatattttaaaatgccacaagatcataaataacatacctaagaatatacataatgaaggaaatgcatttctctcaattgctgagagaaatgaaagggcacctaaataaatggagcaaaatagaatgttcatgtatttgaagaataaatatggttgaaatgtcaatttctctaaatttatctagtaaaacattctgaatcaaaatttgacttctagatatctgcacataaacacaaacacacaatgaaaattatatgcacagaatgacttgtccaagaacattcatatcaaccttttcatgacagtcaagatgtgaaagaacctaagtgtctatttacaggagaatggataaacaaattaagtgtattcttataaaagtatgtaaactcagcaatatgaaaggaatgagtttactgaaacacaatgacatggattgatgtaaaatcaaagaaacaaaaatttaagttgagtaaaagaagccagacacaaaggagcacagactccattgaagtccaagaacagacaaaactaagttctattgattgaaatgaaaagtggttgcctttgggatgattgcctctaaaaggacagaagagaactttctgggataatatagatgttctgtttttggttttgcgtgggtgcatgcaattatcaaaactcatcaaacttcaggtttctgcttttattttgtataaatcatatatcaataaattaatgttacctagactattattactcaccaatttattggcctcatgaattttgagaaaaaaaatgttctgggacatttaaaaactcattaacactatacatgcaagtcatagagatagtaagcaagaaaagcttttcaaaaaatgactaatcttttggacactggacactggcagagaaaagttcagaaaggaagctgcccactgatgaacattgtatgacaattgcttccctccccagggttgctccaactgccttaaggctgtatggttagaattcaaaatatctgacaggaatgtccttgacatagttacaatgatctccatcactgcttcagcaagagtgatgttttaatgtcttttttttctttctccttaaactatgctgttagctttaagcctcggggcagaagcacagtaaagtggataactaactgaaatatttaaaacaaccagacagcagtattcatgaaccagcacaatgacatagcagagaaaatctgcctcctcaataacagcatttgttagattaggaaagacacttttagattgagagctcatcaaggacaggaatttgtcttttatttcatgtaacatgtcatatgtcacaatgttaggcacacatgttcaagcacaattttaatataagcaggagcaatgctgtctaaatgttcttcatggggatatatcagtaagttagcttttgtcacaatgatgttgcataacataccactccaaaattcggttgcttaaaacaacaatcatttattctcggggatttgtggttggcttgggctccgctctgctgactcatgcacttatcggggaggaaatgcaaagtcacatggcaaagggtttgcataccaggaagggtgaagcattggaaccaatgatgtaatttactacatgaggatcttaaattttaaataaaaattctaggaagcctgttggtaaagtatgaatgtaagagcatattgccctactgaatcaccttgattatatacatcaaagtaaaccaagagttttggaacattattgcctggaatatgaagtcttgtctggagtgtaaatttctctgcctgcttcactactttttaaaaatagatctatagatcaattttggggtaattgagatctaaacaatattgaatctttctatccataaacacagtatgtctttcaatatatagtgagattcccattaccttttgcttttaattttagagttgatttgaaactcaattatatagagcatgtgcgctctctctttctctcgctctctctctctttcccccaaagaagaaacatttttattatttgcagatgtaaataattcgactccttaatttattcccaaattgggacatagagtcccttggataataagctgcctaaattctgtagctttggtttgagtgcgctgaagaatatgaaaacttcataccacagatcctgacaactaagtctaaacttcaaccctattcccaatacctaccctgcctcatatgataactgacagcattaagggtgatagggacatgcctgaaagggcagagtgataaagcaactcaagtggtatgatggtttttggtcttacacatgatcagctccagaatttacttattattaaaaattatttatcaatacacagtgccttatgtactagactctatacacataatcttctattctctcttggatgataaattcccctacctatttacctattgttttagcaaccagattaacattctatggtcatgttaagtatgggattgcaaagatttacacaaaaattgaagattaaaaaatgccacagcctttcgagttttcacaatcaaatctgaaaggtaacgtgcagctcagtctgttttcaaaagttgtcagtatacctcaggatcactttagttacctctccaccttgatgactataggacactggtgcctaaataaaggacccgatggatctggctcacttagggaattaggaagccatgttttccagttatccaagtttgtatttttaccctggtgagtgaaggaacataattgtaaccactggggagttcaagttttgaaatacaaagtcttctttccatcccaagattgagatagtggacttgtgccacatcacaaagcaaggaaagagaggaagaggatcacaataagtgttgtggtaattttgtatgatgtcatccaagatctccctctgaaacagtaggggattttgaagtatcccttataaggctagcccagcttggtgacgacatgggctatctcagtgaatgttctacaaagagcagttccccagaagtagtaccggtatcagatgactcagctacccaggagtatggaactattctagaaagcaagggaatatccacaattcatagaggagccaatagagctactttcaagagtagcatatgagaatcctctatgctaggaccttcccatgccttagaaattgtgacccaccagagatactggtggaaaaagccacttaaattagagaagctgctaaaaatcacaaatacttaacaaactacttccatggaggaactaccatcagaatttctttttggcaagaaccattcctgggaacataaaatggctttgaactcaggaaattcatgtgctgtggtcttctctggcatgataacatgtgttattatccttcctcatgcataagaagatttgattttatattggcctatcaatagagttctcaatgagaaaaaaacaatagcaatatagcaattattttcaccaatatgacaagaaccaacttagaattggaagcccctaaactttgcatgtggattaattagttacagtagccttgaattatatcccatattttggagcccagttgattctgagaatagaggtttatacagagatggacatgtctggaccaacaaaatggaattgtgtttgtctatttctcttagtttttaaggttttcactgaaacgcacttttgacagtagacagagtatatcagctgcatactgatattcagcttaattttatgagaggcagtagagtagaagatgatagctgtagtttagaggaattcactttgataaatgtggatgttgctaatgcaaatttaattggaattgatgaattttcagaacttgatgtcttgcctgatctttagcagaatgtgtagggaaataagaatgtgtaacataaaaggatattttgtccttttaaaaatttcaattaacatcctcacatcatgcttgtctttaaatagaagccaaatatgttctggatctgtaacataacacattttctgctatccatgttacatagcttgcaacaataaccaatctaataactgtggcattgtctctgcaaagattacgggtaaagattaaaagctgtcctcacacaaataaaatcttataacattcaagtttgtttaatcttcagttgtctgtggtagagaagactcatgtaaacttgggactgaggcacatgttgaacctctctggacatctctcagtttatccttggagtgcaagtaatctggatcttcatggagcatatcgtttttcaacctttgtttttgaaaaaccatgagtgccattttttaccatatcagaaaaaaaatctgagtgcccgtatgttatttttatacttcctggatttctgtcttaaggcacaaatagccggatagtacatagatgctagttattaacctatggttatatatgggaaagtaaatttgagttccatttccaaatgcatcaacaacaactacagtaggaggatgcactcatcttctccccggttctaggactcagacaatggtttccatgtcttatatatggactcaagaagagtgaagtatagaaaaataagaggccaggataggagcaacaggggttgggaagagaaaagagacacacacctggtaagcaaataagttatgtatagggaactgcctctaaatccaccataggcatttcgttattgagaattcctattttctatttaaaattaaaatccttcaccgaaaccttttctataactttttcctctaaataaattgaatttgtaatgctctaagctgtcaagaaatacattttggaagttacttgcatttctctgaaacgcagttgatacatgaaaataaatccagattactgctgcttattcttttctttcatatgaattctaaacatctagagttagtcatttacatttgtttgttataaattattaagtcactcttaaaaccaccatatgtagttttcttgagtagtcaactattaaaacgatatgctttgtaacaaccaactacaaaaatcttggtggcatataccgataaatatttgtttctcacattctcgcatgtctgagagtaggccgtaagttggctgagctaaactaagcttgactgtcatgatttggctggggcagctctgttccttatatctttcattcccctcctgagatcggcaggagcttttttttttttttttttttttttttttttttttttttttttttttatagtaacggcagaagtgcaagagaataaacctgatcatatacaagcatgtctagcattttagacacatgacttccgctgtcattccattggccaaaaaatgtcacattatctaactccaaaaccaggagtagggaaatcaacttcacctctttagctggaaaaactaaaaagttacatggaaaattgtctgcctggaatcagagaggaataaagaattggggctattaatgttatctactataccttataaactcatatgggacatatcttctttatttctctttgtagaggtacatacatgcatatgtatgcacaaatgtatgcacacacatatacaatgtccttaactaaatgataatgttttcttatggggaaaggtaaatctatcttaagtaaacataattttgagaggaaaccaattggtaaggaaggaaagcaacagcagacaaactagctagaaaacctgaatcagttgttgtgatcaggattctccctgctctctctcttcctctctctctcccccatacacattcacagcagcttccttgaagttgtagtgtataagaacaggacatttaaaagtattcaaataaccttctcagataggacatttttcagtagtttctttgaatatatatatcagtcatgaaaataatcctcatttctttgtaccaaaaaaaaaatgatcaaatgagtttcagttgttgtgaaaatggcattgggaaattgccttgggtaaatcagcaacatagaggagggaaaagcccacacactcagtaggcgtatctttctcagaatcctatgtattgcaaagagatagataagtaaatgccaccaaggaaatctcagtccagccttgctcaggtacctgagtcactctttaacatcaccggtatgacactttcaatttttcagagctgagataaatcaccaagcctcgcagctatgagtatcatgccgtgttctgcaataccgccagatctcaccaccctcatcagtccaatcacagaaagcagcagttactcatcaaagaattttctcctcttcagccctgacctttagtcattgcttagctcatctctcagtgaatcccctctgcatgccagcccccattttttgtttttttttttgttttttgcttatgtcctcattaccatttcttaggttattgacaacaatttatcaaaacaaccttttccctcttcctactcctctaattgaatctatcctgtatactattcccgtaggctttttctattattattatactttaagttctggggtacatgtgcagaacgtgcaggtttgttacataggtatacacataccatggtggtttgctgcacccatcaacccgtcgtctacattaggtatttctcctcccccctccccccaccccaaaacaggccccagtatgtgatgttcccctccctgtgtgcatgtgttatcattgttcagctcccgcttatgggtgagaacatgcgatgtttggttttctgttcctgtgttagtttgctgagaatgatggtttccagtttcatccatgtccctgcaaaggacatgaactcatccttttttgtggctgcgtagtattccatggtgtatatgtgccacattttctttatccagtctatcaccgatgggcatttgggttagatgtaagtctttgctattgtgaatagtaccacaataaacatacgtgtgcatgtgtctttatagtagtgtgatttataatcctttgggtatatacccagtaatgggattgctgggtcaaatggtacttctgtttctagatccttgaggaattgccacactgtcttccacaatggttgaactaatttacactcccaccaacagtgtaaaagtgttcctgtttctccacatcctctccagcatctcttgtttcctgacttttttttgtttgtttgtttgttttgagacagagtctctctgctctattgcccaggctggagggcagtgttatgatctcagctcactgcaacctccacttcccaggttcacgccattctcctgcctcagcctcccgagtagctgggactacaggcgcccaccaccatgcccagctaattttttgtatttttagtagagacggggtttcaccgtgttagccaggatggtcttgatcgcctgacctcatgatctgcccggctcggcctcccaaagtgctgggattacaggcgtgagccaccatgcccggcccctgttgtttcctgacttcttaataatagtcattctaactggcgtgagatggtatctcattgtggttttgatttgcatttctctaatgaccagtgatgatgagctttttttcatatgtttgttggctgcataaatgtcttcttttgagaagtgtctgttcatatcctttgcccactttttgatggggttgttttttttcttgtaaatttgtttaagttccttgtagattctggatattagccctttgtcagatggatagattgcaaaaattttttcccattctgtaggttgcctgtgcactctgataatagtttattttgctgtgcagaagctctttagtttaattagatcacatttgtcaattttggcttttgttgccattgcttttggtgttttagtcatgaagtctttgcccatgcctatgtcctgaatggtattgcctaggttttcttctagggtttgtatggttttaggtctaacatttaagtcttcaatccatcttgaattaatttttatatatggtgtaaggaagggatccagtttcagctttctacatatggctagccagttttcccagcaccatttattaaatagggaatcctttccccattgcttgtttttgtcaggtttatcaacgatcagatggttgtagatatgtggcattatttctgagggctctgttctgttccattggtctatatctctgttttggtaccagtaccatgctgttttggttactgtagccttgtactgtagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattatcttgggcagtatggccattttcaggctattgattcttcctacccatgagcgtggaatgtccttccatttgtttatatcctcttttatttccttgagcagtggtttgaagttctccttgaagaggtccttcacatcccttgtaagttggattcctaggtattgtactctctttgtagcgattgtgaatgggagttcactcatgatttggctctctgtttgtctgttattggtgtataagaatgcttgtgatttttgcacattgattttgtatcctgagactttgctgaagttgcttatcagcttaaggagaatttgggctgagacgatggggttttctagatatacaatcatgtcatctgcaaacagggacaatttgacttcctattttcctaattgaataccctttatttccttctcctgcctaactgccctggccagaacttccaacactatgttgaataggagcggtgagagagggcatccctgtcttgtgccagttttcaaagggaatgctttcagtttttgcccattcagtatgatattggctgtgggtttgtcataaacagctcttattattttgagatatgtcccatcaattcctaatttattgagagtttttagcatgaagggctgttgaattttgtgaaaggccttttctgcatctattgagataattatgtggtttttgtctttggttctgtttgtgtgatggattacatttattgatttgtctatgttgaaccagccttgcatcccaggaagcccacttgatcattgtggataagctttttgatgtgctgctggattcggtttgccagtattttattgaggatttttgcatcgatgttcatcagggatattggtctaaaattctctttttttgttgtgtctctgccaggctttggtatcaggatgatgctggcctcatagaatgagttagggaggattccctctttttctattgattggaatagtttcagaaggaatggtaccggctcctccttgtacctctggtagaattcggctgtgaatccatctggtcctggactttttttggttggtaagctattaattattgcctcaatttcagagcctgttattggtctattcagagattcaaattcttcctggtttagtcttgggagggtgtatgtgtcgaggaatttatccatttcttctagattttctagtttatttctgtagaggtgtttatagtattctctgatggtagtttgtatttctgtgggatcggtggtgatatgccgtttatcattttttattccgtctatttgatttgtctctcttttcttcttttttagtcttgctagtggtctattaattttgttgatcctttcagaaaaccagctcctggattcactaattttttgaagggttttttgtgtctctatttccttcagttctgctctgatcttagttatgtcttgccttctgctagtttttgaatgtgtttgctcttgcttctctagttcttttaattgtgatattagggtgtcaattttagatcttgcctgctttctcttatgtgcatttagtgctataaatttccctctacatactgctttgaatgtgtcccagagattctggaatgttgtgtctttgttctcgttggtttcaaagaacatctttatttctgccttcatttcgttatgtacccagtagtcattcaggagcaggttgttcagtttccatgtaggtgagcagttttgagtgagtttcgtaatcctgagttctagtttgattgcactgtgatctgagaaacagtttgttataatttctgttcttttccacttgctgaggagtgctttaattccaactatgtggtcaattttggaatcggtgtggtgtggtgctgaaaagaatgtatattctgttgatttggggtggagagttctgtagacgtctattaggtctgtttggtgcagagctgagttcaattcctggatatccttgttaactttctgtctcgtggatctgtctaatgttgacagtggggtgttaaagtctcccattattattgtgtggcagtcttagtctctttgtaggtctctaagaacttgctttttgaatgtgggtgctcctgtattgggtgcgtatatatttaggatagttagctcttcctgttgaattgatccctttaccattatgtaatggccttctttgtctcttttgatctttgttggtttaaagtctgttttatcagagactaggattgcaatccctgcctttttttgttttccatttgcttggtagatcttcctccatccctttattttgagcctatgtgtgtctctgcacgtgagatgggtttcctgaatacagcacactgataggtcttgactctttatccaatttgccagtctgtgtcttttaactggagcatttagtccgtttacatttaaggttaatattgttatgtgtgaatttgatcctgtcattatgatgttagctggttattttgctcattagttgatgcgggttcttcctagcgtcgatgttctttacaatttggcatgattttgcagtggctggtactggttgttcctttccatgtttagtgcttccttcaggagctcttttagggcaggcctggtggtgacaaaatctctcagcatttgcttgtctgtaaaggattttatttcttcttcacttatgaagcttagtttggctggatatgaaattctgggttgaaaattcttttctttaagaatgttgaatattggcccctactctcttctggcttgtagaatttctgccgagagatccgctgttagtctgatgggcttccctttgtgggtaaccagacctttctctctggctgcccttaacattttttccttcatttcaactttggtgaatctgacaattatgtgtcttggagttgctcttctcgaggagtatcttcaccacaagttttaattcaacacctactacccctagacatggttttagaaataggggataaaagagtgaatgaaactctatactccccactctcatggttgttatattacattacttttaatggcataaactgcaattacttttacaccaacctaatagaggcaaaaaagccttgaaccaacaattgcacagatacatttatatttgtaaattgtggtaagtactcagaaggaactaaatggggtatgatgggcatttaacagcagaatctaattttgattcaactgttaataatgctttcagaagaattaaaacctgagtcccaaaagactagcagaattagccagtgaaggagagtttgggaggaaaaacattcttgcagagggagcagcgtatatgaagctctgaggaagggaaagaaaagcttattctggaacagaaaaaatgcccatctgtttgtatagcggtgacaataggagtgctgggtgataagtgtagaggagaggatagagactagagcagggaggtccttacagtccagagaatcttgatcttgactgcaggttggaatcacttagaattttataaaatccggacacctggtttccttcccagaaattgtggttcaaggtgtagattaggcattaggtgttaaaaagtttccttggtgatctgaatatgcagccaagattgagatccactgctacaggctatgtgaaagttagaatattttccccaagtgtaacctttgagctgtttccttggacaagaaaacctcaccccagtttttacttgttgcaaccctacatatatttcccaagttcaagtgatatcttttctttgagtttttttctctttccctgactgaaaataatcctctcatttctctttgccctttggtgttttgtttagatacagcatggaagagcatcagaaactaacattataattagttttgcagacgactttgatgtggcttttttttttaacccatcaattgcctcatttgtcttttcctcattcccatcctcctctctgcccctcaagagtttagtacctagatttgattgcagtagatactaggtatgagtttattaaattaaatggactaccagcttaagaggagacaaatgcacgagacagtacagcatctctaaatcttggatttatattcatgaggatatacaagcttacatccactcaaacattacttggctgtctttgagataaccacaggccaaagtaattgtcattttttatttagtgttgtaagccaagatgaaaaaaagatggtgttctgcaggctccaaatttgatcttactttaatggttttattttccattataacttttaaaacttaggaataaacatgctgaactcttctttatttgtatttttctggtgaaccatatatctaaatggtgttcatttgctttggatgttcctggcatcatttttatttagtgcctctgatcttgttaaaggtagaatccatttttattttttaatcaagaattctgtctttgatagtgagttactgaaaaaggaattgataaaacctgaactctccagagggaatttccctggcctgccttgtggagatagcccaacatcaggctgggttattaatcatgcctttctttatggatctcaagttcttgttctttctcctactgttgaagcaaaataaaagcacttaaatgaaaactcaaatacatgttttacatcaaaattcttgtatggaaattaaacatataccattcactcggtaatctgcaagcatagatgtagagagaaaggcagaatatttcctttctgaaattgctttatcaatttgactacctttgataggaagtagtataaaagtaaattcaaatagagttaaacagtagggaaagatttttatttcactaaccagaaagacaagagatgggacaactctatggctgattaaatcagaggctcagtgacccttttaagaatttggatttttctaatttctgtttgccatccttcctgtttcaagctcttcaggctaatttccctcataacagtgagatggcagcctcagtttcaagaatcacatccaaactcaacaatgtctggaaaaacattccttgatcttcttcggtcttcttttttaaaaagcaagtaaatacctcccccaaagtttcatcctccttccccactgagaagacttcctctcaccatttcattgactaaaattatgtaacaaatccatgtccaaaacaaacaaaaatgatatcaccaccgtagattcatctctaagggcaagtttctgaaacacatagccaacacttctcagtattttggctaagatcaaatatagtgtctaaaacacatggcccagtggaggagggtagataactgaacaagactgagaaaaagtaatagaataaaaacagatggagagaacaaagtatcagtgtctgctataactggcatggggttgaaaagacatgaactgtagaccattatatttcctctttaagagggttttaacgttaaaattggaggctttagaaaggctactctaattttttattttcaatttcaacttttattttagatccaggggctaatgtatgggtttgttacatgtgtatattgtgtgacactgaggtttggggtgcagttaaacctgtcacccaggtagtgagcagagtacccaataggtagtttttcaacccttaccccatccctccacctcttggtagtcccatctgttattcccatctttatgtccatgtgtaccctctgtatgtttattgatttttaatttcaacttttagtttagacattggacacaggctgggcacagtggctcacgcctgtaatcccagcactttgggaggctgaggcaggcagatcacctgaggtcgagaatttgagaccaacctgacccacatggagaaactccgtctctactggaaaattagccaggcgtggtggcacatgcctgtaatcccagctactcgggaggctgaggcaggagaatcgcttgaacatgggaggcagaggttgtggtgaacccagatcgcaccattgcactccagcctgcgcaacaagagcaaaactctgtctcaaaaaaaaaaaaaaagatattggggacacatatgaagatttgttatgtgggactattgcatgatgctgaagtttggagtatggatcttgtcactctggtagtgagcatagcacctgataggtagtttttttaaccaacccccctcctccaccctctagtagtccacagtgtctattgttcccctctttgtgtccatgtgtactcagtgcttagctcccacttataagtggcagcatacgatatttggatttctgttcctgaattaatttgcttaggatatggcctccagctccatctatgttgctgcaaatgacatgatttcattattttttatggctgcataatgctccatggtgtatacgtaccacattttccttgtccagttttccattgatgggcatctgggttgattccatgtctttgctattgtgaattgctcagtgatgaacatataagtggatgtgtgtttttggtcgaatggtttattttcttgtgggtatatacccagtaatgggatggctgggtcaaatggtagctctgttttaagttctttgagaaatttccagattgctttccacagtgactggactaatatacattcctaccatcggcgtataagtgtttcattttccccacagccttgccgacatctgtttttgtttgtttgtttgtttttgtttttgactttttaataatggcccttctgaatggtgtgagatggtatcttattgtggtattggtttgcatttgtctgatggttagtgatgttgagcattttttcatgtttgttggccacttgtatgtcttcttagaagcgtctgttcatgttttttgcccatttttaaaatggagttattcattttctgcttgctgaattgcttaagttccctatacattctggacattaggcctttgtcagatgcatagtttgcaaatattttctctcattctgtaggctgtcttgtacccaatgtgtaccttgtatttataagtgagaacgtgcagtatttggttagaaaggctactttaaaaattcattgatttcaaaatttcaaaaatgtgaagaatagctttttcaaggaaaaacagctttcaaactcatcaaattatagacattgaatatatgcagggtttttttttgttttccaattatacctccataaagctgttaaaaaattggacgctcagacctggcccagaagatttttaaacaccaggcctcaaacaaacaaacaagcaaatgaaaccttcaacagtgcctcctgggttcctttcttgtgcgatttttttttttaagaagaattttagcattgtggacatttttacactgtgtgtggatgcagtgtgaaaatgtgatattgctaggaggttgaattgaagcaggacaatgagcatggtgttgatcaggagttgatggtaagaaatcagagtttgaatgggaggttttgattagggagaataagctgctagcattggagggatttactcaggctggaaaaattatcaaatctaatgttaggagagatggagggatgggagaaggggttaatcaaattgcaaagctgtggcgggggtgggcagccatttttgaatttgatagtttacttctaaagggttattgccaaatagactggtgactataaaaccctaggatagtaaaatcccacacatttcatgcccagaagacagtgtaacacatagtgacaagtgggtaattctgtccatttgtagaagaaatctcaaataattgcgatgctccggcacctcaagaagttaagcacacttagcccagaggtgcctggagaacctcctgtgagcagcagtgcccggagagagaccattggtcggcaggagtggaaattcttccttcagtgtatttgataacagggacccctgcagggactgcaagtcataatcatcatgtttatcttttcaggtaaatagaagttttcactttcttgttatacctagtcagacatttttttcccactgcttaattctctttgctggtaccaaaatatatacaagatttttgtgtgtatgttggtaatttttttctcttactgttcttgttgttatttattgattaatatatttttgctcaatatttatatcaagcttatattaactgcatcaaatattaattaactttctctccttttttctttgaaacattttgtataagataggtcttatacatttcctggatatttagtaaagatttgcctgcaaaatcatccggctttattatcttttaagaagtagaaattgctgttgtttttttccatgtaatttagtttttaaaatattactggtgtttgtacattttctgggtcacgtttgtttccttaatttattttttctatcccctcaagcatttatcctttgtgttacaaacaatccaattacattctttaagttatgttaaaatatacaattaagttactgttgactatagtcaccctgttgtgctatcggatagaaggtcttattcattctattttgggtgattttggcaattataatttctagacaatttattcatttcatttaatttttcaacattattgggaatatgatttatatcaatgtaagtttcagaatgtttcatttgaggtttatacaagcttaattatttctcccaaggtaagataattagccctaatataactaacgagtaatagccatataataaagctgaatgatgaatcaagctggatatattttgaggatcaagcttggtatagtgggttttggggtggagggtatccagagaaattgaagcatgttagtatttggaaaatgctacgaatattggtttagcaggtggcggaaatatatgagtatgagtggaatgctgatttgcactaggcagcctcatctcttgcaactcaaagtgggaaattgcaatttatactcatttaaatactaatttacatgtattgaaggaggagttattaaatagtaatgaggtaagaggggcattcacgcaaaaggtgagctttttgagggcaggggtttttgtcttttttgttccctgttctgttaccaggaactaaaacggttcctggcacatagtaggtgctaaataaatatttgaataaaggaaagaatgacaaaaatccaatttaatcctcatagcaaccttgtgattataatagcaaatatttactgtgtgtttaccctacatcggatatcattctaagtctttacatgtcttaattaatctaaatccttatgagacaggaaattccatacatatcacaatgagtttagttgttaagtgtgagaaagtgattcaaaaataataagacagaaagcagccgggcgcagtggttcacacctgtaatcccagcactttgggaggcccaggcgggtggatcacctgaggtcaggagttcgagaccagcctggccaacacggtgaaaccctgtctctactaaaaatacaaaaattagctgagcatgatggcaggtgcctgtaatcccagctactcgggaggctgaggggagagaatcacttgaacccgggagggagaggctgcagtgagccaagatcgcaccactgcgctacagcctgggtgacagagcgagactctgtctcaaaaaaaaaaaagaaaacaaaaaaaagaaaagaaaaaagaaaagaaaagaaaaagagaaaagaaaagctgggaggggggctgtggttagtttacttagcttaaaagtacagggatgaatttccagcactgctggatcagtgttttcaaaatcttcctctctccttttagctctgtttccctcaactcaccccatgaattggcaaaagtatccacagctcatctcaggcttaactcatcatctctgtgtatgagtacatgatctaatattttgatgtagtaggtgggattcaatgtaaaaatctaaataattattttaaaatttagttctaagaaattccttgcattttcagataagctctttaatatatttccttcattctgataaagcaaattatagagtggattatatttctcttttttttacactggttgcccaggagatcaagtcagactataagcttcacaacaaataatacattttgttcatgttttaaaaggtcactctgatttatttacattgtttttttgtttgttttaattaaactattttaagaatattgtagatcaatatgtaaatataagaagtagtacagagatattctttgtatcatttactcaatttccttcaatggtaacatctttcaaaaccacaacacagcatgacaaccagcatattgagacagtcgagacacagaacatttattttcatcgccactaagaactatcctgttgcccccttttttttagccataaccactttccttccaccctcctcaataccttcttaagccctgccaatcacaaatctgttctccatttccataatttatactttcagaaatatagaaatgtacagtatataacctttttggattgcctttcttcacatagaaaaattactggagacctgtggaaaatcaggcaggttcctccatggatcaataatttgtttctttttattgctgaacagtattccatggtatggatgtaccacagtttattcagcattcacttattcaaaaacatccgtgttgtttccagttcttgtctattacaaataaagcagtgaagctgctataagcatttgtgtatgcagctttgtttttggttttgctttctggtctaagtaactttttatttatttattcatttatgtttcattgacaaataaaaatggtatgaacttatggtgtacagtatgatatcttgaaatatgtttacattgtacaatggcaaaatcaagctagttaacatatgcattacctcaccattgttttgtggtgagaaaacttaaaatctaatctcttagcaattttcaggttatacagtacatcattattaaccatagccatcattttgtgcagtagttgtcttgggcctgttcctcacgtctaactagaattttgtgtcctttgaccaacatcttccccatttcctttgttccttactagcccctgataaacgtcatactactctctgcttctatgagttcaattttttcagattccacatataagtgagatcatgtggcatttgcctttctgtgcctggcttatttcgcttaacataatgtcctccatgttcatctatgttgacacattgacaggattttcttctttttgaaggctgagtagtcttcctttgtgtatatatttttgcatgaacacaagtcttaatctccttgagataaatgctcaggaatgcagttgctagatcatatgacagttgcatgtttagttctttaagaacattctaaactgatcgcttctcagccttttgggtaagatcaagtgtagaaaattctaacccgtcttcagagtggctatagcgttacacattcccatcatcaatgtatgagttatccagcttttcctcttttctaatgtgtgtatttagcgctatccctttccttgttagtactgcttcagctgcgtctcacaagttttgatattttgtatttttgttttcattctatttaatgtatttttatttctcttgagacttccttgttgatacatttattatgtcctttgtttccaggtgtttggggattttcttgctatttctctgttattgatttccagtttcattcattgttggagaacacgttctgtatgatttcaattcttttgaatttgttgaggttgttttcatggcttgggacatgatatatcctagtatgtgttctgtgggcactgaaaaaaatgtgtatgatgctgtcgtaggggtgaagtgttccataaatgtcaattacatcttgttggttgatggtgtatctgaggttttctgtattcttgttgattctctgtctacttgttttatcaattattgagagaagggtgttaaaggcgccaactgttattgtgatttctttatttctcctttcagttttgtcagatttttcttcacataatttgcagctcatttatttggttcatacacacgtaggattgctgtgccttagtggattgacccttttaacattatataatgtgcctgtctgtcactggtaactttctttgctctaacatctatattatctgatattaatatagttactccttcttttattattgtcttcatggtatatcgttttccatccttttattttcaacctgcctttgtcattatagtgtatttgaagtaagtgtcttgtaaacagtatataggtgggtcatattttaatgcactctgctgctccctatctttaatttggtgcatttagatcatttacacttaatataattattatgtgctggggctaagtctgctattttattttttgctttctcttttttctctttgatttgtgcttctctctctcttttatttttcctgctttcctgtgggtgacttggactatttttagaaatccattttgatttatctggagtgtagtattctctctatatatttttataaccttttattggttgagatacacatatatgtatgtgtgtgtgtatatatgtatacacatgtgtattctcataacagtttactgttgtcatcattttatcagtttaagtatagaaactttacatctctctttaaatccttttactcaccccatttataatagttattttatatattgcctctacatacatttagaaccacatcataggatgttataatttttgcttcaaccataaaatataattttaaaaactcaagaggagatggaaaggctattgtatttacccatatttttgcctaccatgttctttcccccttccttacattccatggttccttttttgtcattttttttctgtttagaaaactccctgtttacattgtttttgggtagttctgcttgttgcaaattcttttagtttttctccatctgaaaatattttgatttctccttcactcctgaaggatattttcaactataggactctgcattaacagtacttttctttcagcacttgaaaaactttgtgccatttccttctggcctatatgatttctgatgagagatctgttgccatacagtgtttttcccttacaggtaaggaattgtttctctaaagctgctttcaaaaattttttccttctctttagtgctccaaagtttaattattatgtatcttgatgtcattttctttgagtttatcctgttttggattttcttggaatatttaatctacagggttgtgtctcttgccaaatttgagaagttttagccaattgtttctttgagtagcttttcagcccttccctctttcttttctttattccagtttacccatgacatgaatattaaatacattattttgaattccacgacatatatttttattttttaaacgaaacaattcaatttgggagtgaatacatacagatattatacatagatatatctggtatttcaaacgtaggattatatccagtcttttttttttttttttttttttttgagacaaagtctcactctgttgcccaggctggagtgcagtggtgcaatctcagctcactgcaacctctgcctcccaggctcaagcaattatcctccctcagcctcccgagtagctgggactacaggcacatgccaccaggcccagctaattttggtattttttgtagagatggagtttcaccattttggccagactggtctcaaactaggattatatccagccttaattggaaagtgttcaaggtccatataagaggtagaatattctataatttaaaaattctaaaatttttgaatttttaaaaatgactttgaattctgacatcaatctgtgataattcatccagaaaagcaagattggcaaacagcacaaaactgttcgatgttccaaagaagagcttttctatattttgaactaatttgttttgccaatatggctttcaataattgagatttaatatgggctgcattttgataccaatttgtttactttgaaataatttaaactgaaataaacctgctcaaaaatatttaatgtttataaaaatacctcagcaaaaatccaaataagactttagttttgggatttgaccaaatgtaaaaataattacttgtaggaggtcacaactgctgtaatttaagtaatgaaggtagtattcatttttaagacaaactcactaccaagagtaacaatgattaacctacttagaatccaaaaataaaacaaaaatgggatcagataatctgttagtattaagttgcaatcagagaaaaattgtaattcatatgaagccaaaatagattccattcaaatagatagtgattccttccattagatgcaaagaacctgactgtaaccattagagtagacagaatacctgagctcctatgtcaactctaccaggaacataattccaagcaaaattgtatatgattctcacagagccataataataaaaattgcggtactggctactaaggtctactagacatttagaccagtagaataaaatagaaggcccccaaataagtctttgcatatataatcaaatgatttttgacaagggtaccaagaaaattcagtggggaaaagagagtcttttcaacatatggtgttgggaaaactggatacccacatgcaaaagaataaaattggatatttaccttacaaaaattaactcaaaatggatgaaagacctaaatgtaagagctaaaacgataaagctcttagaaaaaaacatagagggaaagttttggtttggcaattatttcttggatatgacaccaaaagtacaggcaacagatgagaaaatagcggccaggtgcggtgtctcatgcctataatcccagcactttgcgaagctgaagtgggaggatcacttgaggccacgagttcaagagcagcctgggcaacatagcaagaacctgtttctttacaaaaaatacaaaaattaaccacgcacagtgatgcatgcgtttagccccagctctttggaaaactgacgcaggaggatcacttgagcccaggagtgaggctgcagtttacgataatcgtgccactgcactccagcctgggcaacaaagcaagacttggtctcaaaaaaaaaaaaaaaaatagataaattggaccacataaaagtgaaaaacttttatgtatcaaaggacacaatcaacagagtgaaaaggcaacccatgaaatgagaaaaatatttgcaaatcatatatctgataagggcctaatatctaggatatgaaaggtctccaacaacttgacaagaaagaacacataacccaatttaaaaatgggcaaagaacttcagtagacatttttccaaaagacatgaaaatgttcaaccacacgtgaaaagatgctcaacatcactttcattagttaaatgcaaattaagaccaccacgagatagcaactcactcccattagcatggctactcacaaacaaacagaaaatatctgtgaatatgtgaagaaattggaacctttgtactgttacattgtagaaatataaaatggtgtggctatggaaaatattatggcaattccccaagaaactgaaaatggaattactttaatccagcaatttcacttttggatgtgtacttttaaaaacctgaaaatagggtcgcaaagagatctttgtatactcacgttcactgcagcattattcacaggagccaaaaggtagaaacaacccaaatgttcctcagtgaataaatgtacaaataaaaaatggtgtatataccttaaaatgtggtgtataccttaaaagggaaggaaattcagacaaatgctacaacatgcgtgatctgcgagggacattaggctaagtgaaaaatgtcagtattctatgtgaggtacctagagtagtcaaattcataaagacagaaattagaatggtggctgccaggggctgggataagtaggagagtggggagttgttttttaatgaattaagttttagttttgcaagacaaaaagaattctggagattggttgtacaacaatgtaaatgtacttaacaccactgaactgtgcacctaaaaatgattaagatcgtaaatttggtgttacgtgtattttaccaaagttttaaagattttaaaaatgtataaatctgctaattagaagtaggtgggctttctttacaaagttgaatctgatgattaaaaaaaaaccaacagagttgagatgaatcattgttatcactgtttcctccagcataagttttagatctaaaaattagccagaataagcattagaattattgtctttattttaactgtaaattgagtcttcataaagctgtccagtgatgctcctatgtccaaatcaattaccatttcttctgacatccatcccaaaagaatgtttttttcagtagaatagtgtgtgtattgctagaataatccacttatttgtacatgtgtctgcctctagagtttaatgtcgaggattatcctttagattactttgttttcttgcttcttagtatgatgtcaggcacggagcaggcgggtaataaacaatttactgaattcattaggcaaacatttattaagcacttaatatgtacaagggacaagagagatgcattttttgatgttgtctttctttagtaacagtcaaactatcacacacaaaataatttaaaacttaaccacaatgttattattgaccaattgggtttaatacgttttcttcaaaagatgtttgatattttgtaggagacaaaatcatgatttagcttatgagaagatagggcataattttggaaatccaggcctctgaaggatggaggtgcgtgttttagacacaaagaatcttcctggtatctttgaataaatcccatatttggtagtactgattcttaaaattagatctgaaaggtgcattttctgccaggaaaaatgtgcctgtaacttgcaagtcaattacaaatatactaatgattatagctaagtttagctgctcagtgtagctgtatgggaatgtagaacgtaaactgttattattgtgaatgccagtgtggtattcacaattaccataaactttaatatacttataataaactgttacaaataggcacaccactgtttttacgttgagtttacgtgcaagtatccttagtaattgtatgttaccatttattctcacgttgaataattatgtgtaagcaatccttctgagtaaataatatcatcgtctatattatgttaattgaatgaatgtatgttccattgtttatggaaggttcagtggtgccaatatttcttaagttcacatctttgaaaaatgtccaatttattaaaaatctaatttttaattttagtttctaagtaaaatctggaagtatggtgtttaaaataaagattaaggccaacaggagcctgaatcagggtaaagtgaaagaaacttataaactgatcagattcagatttgtgagatcatcgtctttcattttacaagctaaaataaaagtctagggaatttatggtttgaatcgaaaggtacttttaaaacttagaattgttctttgtgtttccgtgttcaagaagaacaaaaatatgaaaataattatagtgttcagaaacattgacttcatgatagagaatgacagaggtctctatttggagaaggctagtggaacccttttaatgacccctgattattttaaatatacacagttagagtcagccatgaggaacatctgtccttatgagtagtaaattaattattctatgacttgttttgactttaagttctctactgaattcggagacaggatgggaactggggattgcctattacagtttcattaagtatatgagagatttaaaaagtgctcagaagtatttttaagacatcatgatgttcctgcaacttcatggaatgatttcctatattggtgagggttttctaaccaaatgaatcccagaagtatggacaaaatacatacaatattagaaaagtggcaatgggctgactgaaaacatcaggcaatgagaattttttcaatggcagaaaattgactaatttgaaagatataagaactatccatggatctataatgagacagtatgttctctcccttaacctaccaccaggaaggaattggggacaagagtagtggctagaactgtaaactcaggcactagtttctatgattgttagcttcttcctgcaagactagagtggagagggtatctggggctgtgatgattatgctgctccttccatatgccaagaaagagctgaaagttacttggactctactttatccctattataagtgtcagtacaacgtaagtttcaggtggctgcagcctttgttttgctcactgttttgtcaccagcacctaccataccggtagctgggcacattcttggtgctcaaaaatatttgttaagtgaatataatgaattaatatggacttacgcctcgttagaagctatatcaagagaggactacaaatgaactgatcaatattagtaagtgggaattctgggtgataatccagcgtcatttggtatagcctaatggagcatcccagcggtacagaagacacccggaacaagtattttagaaagacctattcgtgtcgtagaggatcatgtaaactggggactaatgagaaaaaaaggcttgaatctaagttaaacagctatttcctttggttttccttttgtacctattccatatgttacgcttagaattatcatcccaaagagggaaacctttcttctgtctctttttttctttccaaaatcaaaaaagaaagtctgggtatgagtaacagtaaactcataccataatcttagtgatattataaaggaaagtaacggtaaactcataccataattgtattgatattataaaggaattctattgatattataaaggaatcttactgtgtctatatgcctggaaatggtgtgtgtgtgtgtgtgtgtgtgtgtgtgtgtatgtgtgtgcacgtgtgtgtttggtgatgaaggaagaggtactaaatttttattttgctggctggtattatgtttaataatattatctttaattattcctattattatctttaatttattagttctcatcaacttttattatagggccactgttacttaatacttaggcatgatttgtgattctggctctgctatactcttcactatttgttaccaaaatacaatcattaaacaatgatgctggcaaaataaaatccattataaacaaaaccactgtcagaatttgatgagcatcatatgaaaaatataaaataataattgttgaagtacagtttcagaaaatactttggaagaaactagaggaattacattagcagaaaatagtaatataattataaattagaagaaaccataatatattgtaggaaactactgcatatttcattttttctctatttgcatctctgttacctatcactacacacatttgagtatggatgtcctaacatataaacagaatcatagaatagggctgaatttgagaacaaaaaattcctgtgcaaaatgagtaaaaataaagtcataatactgtattagaagttgcagaagataaatttacatcatgcaatgtgtatatttttctaatgattacgtgtatctgatagctattacacatttgaaaaataagctagaaaaaaaatagagtctgaaatatgttttgaatcccagtaacaaatctggcatcttcatgatctcattcaatgcttagttccatgattaagctttctaaaaaacaacaaaaaactggcaaagatgttcctagatcacttgacttccaatgcagtgtttcttccactacctcaagttgctttgctaaacagtggtatcacttatgataacttctttaaatgaacatgagagaatttcctgttgatttttgagcaatgcaattaatatgtacaaattgacaatacccttaacacttctttgtaacaattttttttaacgggtccatgttttaccccaagaaaagctaacaaatgtaaatatttattctctcttacactgaaactcttctgacaatgtaaatttacttatgcttgtaacaatatacatttttgacatacgtgaacaagacttgtccccagtttaagttttcttggttataaataaattatgatttgtagaaggcttttctttttcttttatcttccttttggctatgaagaaaattgacagcatctataccaaaccaagtatgtaaatagtcagaaaacacaacaacaaagccacatctttagggaagaagaaacgtttttggagttatataaagagaaagataatatgaaagaggtaatttagtctttcgggtccaggaagatctcatagtggctaaaaatttggataaaagaaggactgagtaatgaaatataaggataagcccatatcagaaacaattaaatttctgtaagttcttgataaatatttgggttgctttggggcactcatacatctttcattttgcccctcttatttaaaatattactgtggtaggggacagggaaaagaactttaagcattcaaaatgcacacattaacttatttttcaacttttattttagatacagggggtacatgtgcaggtttgttccatgggtatattgcacccaggttgagcctaatacccaatgggtagtttttccacccatgatccctctgttcctccaccttctagtagtttgcagtgtctgttgttcccatgtgcaatagacactgcaaatttatgtccacgtgtgctcaatatttagctcccatttttaagtgagaacatgctgtattcgattttctgttcctgcattaattgtcttaggattatggcctccaactccatccatgttgctgcaaaggaaattatttaattcatttttatggctgtgtagtgttccatgatggttatgtaccacattttctttatccagtctacctttgatggacatctaggtggattctatgtctttgctattgtgaatagtgtggtgatgaacatacaagtatataacaaaatttacacatattaactttttaaaaactctatgaaatttataaatggaaatgtggtattgtggaaagaaatgcaattgtttctataagggaccccctaggataactaaataagtcttttaaatctatgtcaatcccagccctttattgcataggatttccaagatagtgctattcacttttcattgctctaagtccctttgctatattgatctgagagaacatgctaagcaatagatgtaaaacaaagtacctaagtatttggcaaacagtggaggcctaaaactaacaataccttcaagagtctctaacagggtgaattgctataaaatggcttgaccaaagcaaattgatgtttgcacacatttcaccattctccctcatctgggaaaaatcatattaaattattttgtgtcttggccaacatatcactgacctttgctttttggcatttcaactctgtccttttcactcttgtaacaaccacagcctcattctattgagagatatatgggacattaaatatataactgaagggatgaatgtcacactaagattaaaaaataaaataaaaaccttagttttccagaaagaaatgttattacctcttcacatgtgaagaaactaacttatcctgttaagatgggaaaaaataggtgaggaaaatagatttgtaagatatgcaacagtccagaaaagtaagaaaattgaattaccacttcactttcaaagcttcaaagaatgaccttgttagcacacaggacttgaagtcatttcaccttcctgagaagaaaccatttgaatatattcaatgtttaagtgtctttttattccaaatagtattttctacttcctcctttcttaggtaattagttttgggctgtgtttcttctatggacatgcattagcatggacgactagagaattacactgttaaaagttggagagccatgtggaaatctgttagaaaactctgttctgtgctgtcattcactgtgtgtgcccattcagtataaggaaggaaaagggaaattttaaacactaaatgttgtgcttctctgaaaagtgtgcaatgcattttttttttgttattatactttaagttttagggtacatgtgcacaacgtgcaggtttgttacatatgtttgtagtataccatctatgttcatcaaggatatcggtctggagttttctttttggttatgtcctttcctggttttggtattagggtgatgctagcttcatagaatgaattagggagggttccttctttctctatcttgtggaatagtgtcaagaggattggtaccaattcttctttgaatgtctggtagaatactgctgtgaatccatctggtcctgggcttttttttgtgtgtgtgtgggtaatttttttttttaattagccaactgatatatttaaggacaaaattacatgaatacaataattgttcattatttgctccttaaatttaaaattttacatattctttttttaaattttattattattgtactttaagttttagggtacatgtgcacaacgtgcaggtttgttacatatgtatacatgtgccatgttggtgtgctgtacccattaactcatcatttagcattaggtatatgtcctaatgctatccctcccccctcccccgaccccacaacagtccctggtgtgtgatgttccccttcctgtgtccatgtgttctcattgttcaattcccacctatgagtgagaacatgtggtgtttggttttttgtcctcgcgacagtttgctgagaatgatggtttccagcttcatccatgtccctacaaaggacatgaactcatcgttttttatggctgcatagtattccatggtgtatatgtgccacattttcttaatccagtctatcgttgttggacatttgggttggttccaagtctttgctattgtgagtagtgccgcaataaacatatgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccaacacctgttgtttcctgacaatgcatattttttaatagaactggtttgcccatcaaaatggagaactatgaccttgctttatatatgcatggatgagtaaacagtatgtgtatcccatcaacttgccctgttagagatttataacttataaattaattatattttcatttatgtaagatacattgggacttgtgtgtgacaagtaataacagctggactgaaaggaatgggtggtgggaaatgggtctgaaaatttagtttgggacaaggttgttaaaggccttctaagtcaagtggaggaactattgactccattttcttcaatgcggatatatatcggttcacactttcaagaaagtccttgtctggtggagataacgaaggaaaacaacaattatagcacagtgtgttatgtacggcgtcaacatccccagcacattttagaaatgcaaaaatctcgagttccaccgcacacctattgaatcaggctctacatttttaaaagatctgtggataactaattgcacattgaagcttgataagcaatagtataaaagaatatgagaagggcatccagtagaatctggctgtgcgtgaggtgtgcagtagagtgaaaggatgcatacaggaagttccagacagagaaaacaacatggtcagtggaacagaagaattaaagtacacggcacattcagagacctgaagatagtttgaagtggctgtaacacaggacacatagatgaaaatgtgtaaaagcaactaagatatccttcaatagatgaatggataaataagtcatcatacatctgtacaacagaataatattcagtaataaaaggaatgagctgttaagccaaagaaagacatgtattattcttagttgcatattgcaaagtgaaataaaccaatatgaaaagactgtataccgtgtgattccatttatatgacattctggaaaaggcaaaactataatcagactagtgattgccaggggtttggcaactgccccttagtgaggtacttttaaaagtttggattggcttcactgggataattttttttttttggaaagttatcaaatttttttacactttaagttctgggatacatgtgcagaacgtgcaggtttgttacataggtatacacgcgccatggtggtttgctgcacccatcaacccgtcatctacattaggtatttctcctaatgctagccgtcccctgtccccgtacccaccgacaggccccagtatgtgttgttcccctccctgtgtccatgtgttctcattgttcaactcccacttatgagtgagaacatgaggtgtttggtttctggttttctgttcttgtgttagtttgctgagagtgatggttcccggtttcaagtctccttaagtcacttataaggttacatttatttcagcactctctaacactagtcattaccaataaataagcaggctttttaataggcacttgagcatgatggacaacacaaaatgatactacttcccattccccaatttcccccttcttcaattccccgcacccgtgactcctatgtaaaagaatcttacagggtcaggtgtgtttctcctggtggtggctattgcttgatgttggtagattagatgtccacagctcctctttagcgatagctcagtgttctggagaagttgtactagctgagtgctcatggaggagttacttaatctgcaaaatagagataacaataatagttacttgattttttagataaagaataaataagttaatatatgtgcaacatttagaacagtacctaccatattgtaaatgctcaatatatattaaccattatgaaaatcatcaattccaagacccacatcatatcacaatttgaattctctgtagttaggacatattttgcaattactggcatctttgattcaaagcaatatgttattatctgaacactgttctatttttctatatatgagaggaaaccatttgaaggagggaagagtcctatagaatagccaatacctgactcagttttaattttctcttccctttcactactctacctttatgaaggttacacagtcattagatgagaaatgtcactacaaatcaaatgttttctcattgttcacaacaatccaacaaagtcagatacttttataactccgtttcacaggcaaataaactaagttttacagaggtcagttaatgtgttcatggtcacccagtgaatagattactgaacagcagtattcaaacccaattagtctttgaagcatttgctaattccaccgtacctctagacccggtagcctttcgtaataatttaacaaaagagcttctctgggggaattacaagcacaaatgtcaattagaacaaacccaataaatgttccatattacatttacaaaacagaaaactactaatttttattgaattgggctgatttgttttctccttgaaggtgactgtttggggagctaaataatgctatttcattcattgggatgctttacgcttcagctgctgtaaatattaacagttaaagaatttaacaggaggctaatgtgagtgctctgagaagctattctataaggttcttagactaggcaggtttttattttattagagccttgttaatttaaaatatattggaagtattgattctacctgttactctaagcatttgtatgatattagctacattttctcagctttctacaatttactcatttgtaaaacagatgaaggtggagataaactattataattttagtagacacaaacatactgtaatatacttagtttttatctttttaactcctcaaaattatactttgtgataatttaaataagggcttccctggactaatgttcatattgtctctgactataaaaatatattaccaaatatataaatgccatgaaagattataaagagtatcttttgacctgcttaacatattaatctgcttcgagcctcttactagtactatttacatgtattattcatatatatgcctaaaattttctaattgccctcactttgttagcctcattaaaatcagcacctgtaagaatattttaccacattatctgttttcagaaaatatgctccagtctttctagaaatccagatcaagagttcaggttagtaaagtttatatttaatttgccttattttcatacatgatggccatcaaatatgatgagataaaatgctccatgtacagctaaacattagggataaacaaatacagaagtaagaaaatggccatacaggctaattctcgtgtaaggaatacctccaagtcccaggatctcagagtcccctgaactcactaagcaaatgcctagttacccagtgactgagctagttctagtcataactgagagttcatatggttcatggaaaaattaaatgcaagtactgaatcccagccataaagttagcactctaaatatccttggtagtttactaaattctttacactggttataaaacagctgcactacatgaacaagtaaataatccacatttcataaaggcatttgttttgatggaaactattttactgactgtggttattcagcataagataagaataaaatttaacaaattagttaaattaatattaagaatgcatctgtctatatagttatatcacaagagaatttactgaaaaagcacactgtttatacacagaataataaatacattgatagactccttgataactgaatagaactatactttggaattgcaaactgggaattgcatgatccctagtatcaaggggttcaaagcctactgaggacatcagtgtggaaaagccattatcccattacaatgtgaaaaatacaatgataatgacggcaaaatcttaagggagcatccaactactagaagaattgaaaaggtcttcagaaaagaggcaacgcttaggattggccttagcacttatatttcaccatagagaaagaggtaggacggtgactgtattagtctgttcttatgctgctaataaagacatacctgagagtgggtaagttataaagggaagagttttaatgggctcacatttccacatggctgggaagcctcacaatcatggcagatggcaaaggagaagcaaaggtatgtcttacatggtggcaggcaagagagcttgtgcaggggaactcccatttataaaaccatcagatctcgtgagacttattcactatcatgagaacagtatggggaaaactgtccccatgattcaatgatctccacctggccctgctcttgacatgtggggattattacaattcaaggtgagatttgggtggggacacggccaaaccatatcagtgacactaagaaaacagactaaggccaaacataaagagtatttgatcaaatagcagagaaggctaacacatctacccttctttccattcattcaaaatcctaaacactgaatatgtatttatgtaatatcaatacacatacacacacatatatacacttacatatgtgtacacaaacccctacatctataacttaagacagatgaccacacatagacaagaagacttagagaaagctgaagcagagagccaatgggattgtactgatccattttctaggaaagcataaattacccaaattaacagggaaagatgtagaaatacgaatagatcaaagatagtaaaatttctgatccttaagagagataccaaacaaaactcacctatgatgaagtaatttgaatagtccaataactattaaagaaaatgaatttttagtttaaaaagtcctggaaaagattgtatcctttgctgtgcagaagctttttaacttgatataatgtcatttgaaatatttaggtccagataattttactggataattctaccaaacatttggagaagaatttacaccaatttaacactatctctaccagagaataggagaagaatctccatcttattttataaagccaatatcaccttgatgccaaaacaagacaggacaataaaaaaaatagaaacaaaaaacaaaaaccagcatccctaaggaccatagatccaaaattcctcaacaaaatattagcaaatccaatccagcagtacatttaaaattatacaccatgacaaagtggggtttatttcagaaatgcaaggcttgttcaatattcagaaatcaatcaaggtaacccacatattaacaagctaaagaaaatcacataattatgttaattgatacagagcaatactttgacaaaatcccatacccatttatgatataaaaaactcacccaactaggaacttcgtcaaattgataaagaaattttactagaaacctgaagctaatatcacacttaatggtgaaatactaaatgttttccccttggaaacgaagaaaggatgtcctgtctcaccaattttattcaacataatgtcattttgttctctaggactagaattcctagaaaattctagaaatctagaaatcctagagagcaaaatgagacaagaaatgggaaatttaaaggcatcaagtttgggtaaaaaagtaaaactgtccctgtttgcagatggcctgattgtctatatacgaaatccccaaggaatttatatgaaaactattataattaaaaagttacttcagcaaggtcacagaatacaagatcagtaaaccaaaatcagttgtgttactatagactagcaatgaacatgtagaaactaaaatttaaaacaaaatatcatttatgttcattcaaaaatgaaatacctatgtatacatttaacaataaatatgtaggaattgcatgctgaaagctacacaactctgatgaaagaaataaaaaaaaacatctaagtaaatggaggatataccatgttgatagattgggaaattcagcatagtaacagtgccattgcttcccaaagtgttaaacaggtttaattcaatttctgtgaaaagttcaacatttttgtgtatataaacaagagaattctaaactttatatgaaaaggcaaaggaatagctacaacaattttgaaaaggatgaggtagggtcagatatttcttgaagtttttttagattttttttctgtactattctttctattctccatctaggactccacattcacataattaaatttgttacattattctacaactaaccaatggtattagctattctctattgatgtatctctgaatttactgactctttttatattatctcccatcttctattacgtgatttttagctcagttattatgtttcagttctagaatttctatttgtttttttaaattgtcatttatttgttgaaattctcttttgtctatcatgagaatatgttcactcactttattgaacagttttaagaactacggtatcttcatatatctagtaattttgaattgcatctcaacattattagtgataccacttatagactgtgaattctgtcatgttcccctgaagagtgttgatttcttttttgctttaagtgggcagtgaacttggttgaactcaaattccaaactgtgtttcttgtgataggcagtaactgaaatctctgtcactccttttagctttagccaggctgtttggagtctgtcctgcacatgtgtagtacacataattcaggagtcagtcagaaatttgtgctgagattatacatgcagcatttggatcttcccctctatggctctctttgtcaagattttaatttttaccttccatttgctgtggttaccctaaattctgacctgtggtttattaacccagtaaacggtggctttttatctgagttctggatgcttaacacagtgcctgagacccgaccttatgtgaaaggcgatgaaagtggaaaattctatgagtgacattcccttctcctaatgaagctccctaggcctgaagtttccttgtaggaaggttttttaagtagctattatttcacaataaaaaaaattaaaaatacctttaatctctttaactctatgcaaggcacttctaaaattcattagcattttcttttgcagtgtgttataatttgttaatatttcattataatcctttgttaaaacaataattttatggaatcgtaaggttaaataatttatttctttttcatagtgttgagacagtttcaattcttattctaataattcatattctatttgtattatgttaaatttgattaagttgcctaaaattgaaactcactggagcagtattttaatttttgttcctaataaacaggaattttgttcccaataatcttatagccctgttctttaatactcatccataaatttacatatgacattctttcaaatgtattaaccacaatcaaaaaataaaatggagaagaataatcttttcaacaaatggtgctgatatccatatgcaaaacaatgaagttggacccttaactcatgtcatacacaaaactgaactcaaaatgaatcatagacctaaatataagagctaatactataaaactctaaaaaaattgttttcttggttcagccaatgatttcctagatatgacaccaaaaacacaaataccaaaaaatagataaattgcacaacctcaaaattaatacaaaacttttttgttgcaaattataccatcatgcaagtgaaaagacaacccacaggatggaagaaaatatttgcaaatcatatatctgataaggggattttatccagaataaagaattcttagaatctaattttaaaatgggcaaataattaaatggacatttatccaaacaggatatgtaagtggtcataagtacgtgaaaggatgctcaacatcatgagtcattaggaaaatgtaaatcaaaatcacaatggataccacttcacacccgctagaatgactgtaattacaaagtcatattctagcaagagttggtgagaatatggggaaatcggaaccatcatacatcactggaaaggatgtaaaatggtgcagctactttggaaaaacggcctcacagtgtaccagaatatggtacagtattatcactctctatgtgttctaaagcatgacagatttcgaagagtacttatctattcaagtctttattttcccaatagcgaattcagttaccttggatcattggctatttggtctcctcagaaagacagtataaggcaaaactcaatctaactccaggtgtctagattaaaatagactagcctagtctgacttcaatggaatgaagtggaattacagttgacgcctgaacaacacaggagttagggatgttgacccctgagcagtcaaaaatccatgtataacttttgacttcccaaaaacatttaatactaatagcctactgttgactgaaagtcttactgatcacaaaacagtcaattaacagacattttataagttatgtgtgttatatactgtatctttactatagaataagctagagaaaagaaaatattaagaaaatcagaaagaaaatacgtttacgttactgtaccgtatttattgttactgtaagtttacattgtctgtttacttgatgaattatctatctgaaatggcagcaactacagctgcagacttcaatctatagtacatatcactcaactcaactttttctcataatgtcatgacttttcttggcttcttggaagcacttccagcatcacttgtggcacatcgtatgggtcccatggtgttattcaaggtttatggtattgcactaaacatgatgaaaagtatgcaacaaccatgagagatcactttttttttttttttgagacggagtcttgctctgtcacccaggctggagtgcagtggcacaatctcggctcactgcaacctctgcctcccgggttgaagcgattctcctgcctcagcctctcctgggattacaggtgcctgccaccacgcccagctaagtttttgtatttttagtagagacggggtttcaccgtgttagccaggatggtcttgatctccggacctcgtgatccgcccacctcagcctcccaaagtgctgggattacaggcatgagccactgcgcccggccaagaggtcactttttactgccatctacaatttactggagagacgaactgctcacagggagaggattagtgtcccaggacgttttaagcagatactcgcaatacttgagatcaccacaatagcaacaggaggtggctgtgaaacattacagtagtacagtctgtactacagttaattttatgcagttatggtttattactgcatctttacatttgtttacatctctctcgactgcaaatggtaccatgtatggtctgtaaatgtttgtgtgtgttagttttgataaattttaacttattagaatagattggggtataatttatggtagtaaaggataaaatagactagtatttacatattttatgcattcatgacatactgaacttttccttatttttaaaatatttttagactacataattcatctgcaagtttttttttcaaattgttgcaaatctccaaaacatttttcaacatatttgtttttaaaaattcaagtataagtggatccacacagttgaaacccctgttgttcaaggctcaactgtattttattttgcatcatttcccatagtggtgaaagctgggaatgcagagtgtgttaaagagaggctgtgttcccagcatgcaccactaccagagctttcctgtctaccccatccttcagtgtttcacttgtaattgctacacactgccaggatgagaggcacctttgtcagtatcccatctatttctttttctcttctctttttttggggatgttacattttaatcagataaagaaaattgggacaggggtagagatgaaggggaaattaaattacactgattaactgagtaaagagtgtattagtttcctaagtctgctgtaataaaataccacaaactgggttgtttaaaacaacagaaattgattttttcacagttctagaggctaggagtctgatatcagcgtttcagcaaggctgtgctctttctgaaggctctagggaaagatgtgttccatttatctctcctagcttctgatggtggccagcaattcttagcatcctttggcttgcagaagcatcactccagtctctacctccatcttcatgtggcattctgctctctgtgtctgtgtctctacattcactccctcttcttttaagaactccagtcattggatttaaagcccaccctaatctagtataaccccatcttaactaattacatctgcaaagactctatttccaaataaggtcgtattcacagatttcaggtgggtgtggatttttaggggtcactactcaacccagtacaaaaagtagtatgtgtgatacagaagactatccaagagtgtatgtatgtgtgtgtgtgtgtgtgtgtgtgtgtgtgtgtgtgtgtgtgtgtgtgtgtgtggtatagaacctaggagcagttgggagaaaaggagtaggtatatcttcagtatgtgcatcactgaatgcattctttgcttcaggcccctcactattaggcaagcagtattttatttaacctttgctacaactctgtgccattgagtattgttaattccgtagaagagcaagctgaggttgaagaatctacctaaggtcacactgttcctaggaggttcaacttggattcaaatgatgcatgcctgcctccaaaacccattaacttaaacactaatctctactgcctaaatgattttaagaaaaagtgataggttttaattattcaaatgatataagggaaaggagaaatctaaggtgatgcaagtccgagattgtataactggggcattagctggtaccactaatacatattaataagaggagatcatcacaaggcatgatgtggattttccttttgtttccgttgaggaatggagtgagagtggtaaatgatagtccagactaaaatatatattgatataaagaatctgagaattttattgagggagataaatttgtggtctgcattatccctcagttcccacagcatcatttttcagcaataggtgactaggtacttttcatttgattcaaaacctacggtcacgcatgaagccacctgcctcaagtgccgcatgctaccacagaaaatctctttctcactcaaacaatgttgtatttgttttactttgttcaaatttatttaaaatgtattaattataaaagaaaaaaaagtcattccccatgtttgtgtttgcttttcctaatgaaatatgtgcagctggatctaacttcagcctttttttcatgtctaatcagaagccactgtacccaatttagctttgtttcagccattacatgctgtgtcctctgcagtgcgtgcctagatgagtcactcttcaggtgacttctttttattaaggctatttgtaaaaagccacaaccactgcaaaatgagagtactggattggtttgttacattaaaataatcattttcaagattagatgtggtgactgtagccagaatatgcgaatggaaacattgcacaaaatgtttcatgttgcttaaaacaaaaataggctgtgaggtatctttattaactatgcaaattgtagacaatggattttttaatgcttgcaaacatgcttaatttttcttggtggtacttacattttatagcataataagtttaatgtctatttttagagcatattaaaagtatttgacaatgtaaaatcgcttgcaattcagaatattctattatgagacatttccttaccacttaagaaaaagccaagaatattattttttataaaagtatacttcaaatatttaatgaccattttatttaatattccttattagaacatatatttcaagaatgtttttggaggcataagtaagcattagcaaaacctagaatatttagatcctattcttctggaagagatagattcgagaaaaaaaccttttaatttttgtagatgtgactagaagatttaccctttccctccataatgtctgcctatttcataatatttatttatgctttcattttcttttaattgctaatttgcaatgagctcctggagaaaagatactgatacttattgtgcaaccgtgacttcagaagcaattcacagttcctaggaaccatatcaaataagtgtgccatccctgaaatgggtgggtcaaatatggtttaaatttcttttagtaaaaaataaggttttattggaccagatatatatcacttgtagaatcagttgaaaagatttgacatattggtttatatattccttaatctttttatgcaaatttgtgaatttattttgaaaaatatatatttcttgccagtacctgagaaaatactgaaattcatattcaaaatataatcttatgaatagtgacatttagaaataagtttctaaactgaaggttttcattgtataacaatatcattgaccgggcaactgtattctggttgcatatgaaaattactgtgaaggaaaagacaattgggaatagtttataattccaatatcgagctgacaaaaatattcattattatgacaatttattttcatcttctggaattctatttaatcagcagaagagttgtggacataagaataaataacattatgctaatacagggaatagcttccaactgcacgatttatgggcagacatttttgtatcttaaaaatttttgagtattccaaaatgtggaaagctttccctctgaattttcttgggccactcctgtccttcctttgcctggtgataggggtagggaggtgactcttacccctccttaaggcaggtccaggcagtattcctccagaaaaacttcctcaattacatacccataagccattttattgagagaccctgtgctaggtactagatataccaagatgaatattaaggagtccctgcctctaggtgctcacagatacagggaatgaatgagtatgagaattataataatgtgataggcactattcagagggtctgagcaaggccccaaagcagacacactgtataactcaggtgagagcttgagttttgaagtcatgagatattttgatttgaatcttatttccaccactaactagctacatgaccattggcaaggtacagcatctccttgagcttccatttcctcatctccaaaatgtagatactattatgttagatgtgtcatatgacagttctgaggattgaattaactcatgtttggatattctttaggacaacatctaacacatggtaagtgctcaaaaataataactactcttattgttatttgtttgtaccagctatctcgaggcaatcttttgtacttcacacagagccactgccatctacccctcaatcactgccctttccaatccagccctaagggagctagacacagcaccccccactaccaacaccacattatctgctcagtaaaaaacatcttaatcaatcttgcacatacaagataaagactaaaacctggcagttattatctaatcaggttactaacagtttttccactgctccaagtatgaaagtatatatacactaacaaacgcctatagatcagggcccagcaacattctataaagagccagagagtaaataactgaggctttgagggccatgatttctgtgtcacaactactcaactttgttgttgtattgccagagcaatcataaacaatatgtaaaaaatggatatgactgttttctaatacaattttacttatagaaaaatctccttagattatagtttgctgatgcttgttagaaagcatatagtatggttatatattatttctatatcataacaaaatacactgtgaattcattgaggccttacacatctctgttttacacacacatatatacatacacatatacatatacatatacacacatttatatgcacatttacacattccattgtgtctcaatgaatatacttctgaacaagtaagttgatggaaaaattaaatagctcaacaactgtatcttgataaaaatatgtatatatagagagaaaaggggtcagagttatctttctataaaaatgatgtaataggtcaaattaatttaatatgtaaattaattcaacctttaaaaataaaggaataatgggggaagatggaaaataagtgatccatttgttatgagggtgctagaaatagatattgtaatcgtctgtgtttatgtgtgtggagagagtctgagaaagagagagacattcagataaagtaagagagaggtttagagtaggaagacgctggataccatgacagagcattagattttgttctgaattttcaggcagttaaagcaaaaagcaaaacacactagaatatataatcaggtcaacagaaacctacactttcttcataagggataaacctttttcctggtactgaaagaactataatatgtttttttctacaaggaatactgaacaacataatagatcatgtttccagtaatgggtttagaaaggtacacagtgtccttcactttactttttcatatgcagatatttgacaaagcccaaagacacagcattaaaacattattgaaaagatggcttttggagaaatttgatttcggaattatttctgtcttgtattctacaaataaggacagattcaaaggatggactggtggtgtggttcatcattgttcctcagtatgtccaggcctctaagtgatcactgacttattagtcaatgattagaagccgtgaaatttatgtcaaacaaagcacttttccatatattatctcattagacctctcaacaaccttgggcaagcattattatcaccaggtttatgaatgaagaaattacactgataagttatgaagtatgacaactccaagtaaaagaataaaggctatatatagctcactctctacacagattagtagcatcttctgagattcatcattccagtctaaaatttccaagcttattttttaaaacagagtaaaactttcttagaacacaatgtgaaaactcgatatacaaaagaaatacagagctgttctggttaaaaacaagtgggacaggtccagacaccaacttgtttgatgtcccacttcacctcaataatcttccagaatagttcccaatgcacaaatatccctaaaaatccttattgctcagtttgaaaaccactggtctatatcagtgaagatgcaaagtcctccacttaggagacagataagcacaaatttaagaagtgttttataggacccagggcatgattggctttgccatttagtataagaccctaaaggattaaaatgcatggtttcattctacaagtatgcctgatgacagttggttgaaacttatgcaaatgtatttaagaaataaaataatccattgggaaatactattgttatctaccaaatttttgaaatccaaaagaatttagccatgataaattctttagccatgatgaaagtccatgtatatttatgcacatatgcgtgtgaacgcgtgtgcacacacacacacacactcactcacacacataactatttggcacaactaaaacaacctctttaggctgattacctgtttacctttactgaaacttggctgtcctcaaaggttgtggatcctatcatcctctaaaacaaagctgtactgtctttctctaacatttcaggacagatatctcccctttctctccatttgcagttccagaccttgatactcttactgttctgtattttttttaaaaaaaacccataaaattctttattctttgaggggcggaccatctggccttttctactttcttattgctactcctttaaagttcttggtcattcttttcgttcactgaagaattttatcacctagttcccattcttctttcacgccccagtcactgttattattttggcaatttcaacatccaagtggctaaaaactcactctgaattatttgacccatactcattaccactgacctattccacccctccacaccagcttgaaccagggcctcaaaatctgcactaactccaaaatcaaaagttcaaatattctacttcctaaccgtagccttcttgccatccagatattttgctctaaaacttaaactacaacaattattacctccagtccattgtttctattgatagattgattgttctttatctaccatttccctttttatcactttcatcctgactaacctaatcccattggtcctttgtaaaaaaagacttccatctcatttcattgtatttcccttgaaaaccctctaacctacttaaaccaaccatttaccttttccatcccagccactttgctggagaggattgtaaaaccgggcaggtttcgttcccgttaacttccttagctcaaacctaaacggaccctcagcaagctcagtaactctatattattcaagtcctcgaataactagtttagtccttctcttccctctttcaatctccttgcttggatccttcctctttactccgagattatgacctcatctcatgctttcttaaggaaaataataaatattacgtggaaattccatcttctttccgctaccaaattatgaacctactgcatctcatcttctttcctgttatgtctcaaggagcatcttgcctcctactgaagggcggtgcttctgcatgtgctgttggtttcatcggctagaaaacaatctccatgaggaaagatagtgtctgttctctttttaccatagatatacctcaaactttgtacaatgcttggtgtaatatatacttcggtatattatttatatttgtatgtgtgtgtttgtaagagagagaaagacagaaaaagagatgcatgtatgctacatgtcttggcttggcttagaaaacctaataaccaaaatccttttatattgccctgtgatattttaactgaatgtctcataaaagattatggcattgcaaggtacagtgctacctcttcatttcaggaagagtaccaagcgaccaggttatcgtgcagacaagatagagaaattattcctagtcttctatgaaaatcaaaactgctaaatttaacatcccatacatagtgagaataataagcctataatgtactcaccgagctctgaaattgcattcacttagagcattaattttccagaattatttcagttgattctaacattaataaaagtgcattacctgttttaataatttgggaggaaagaagaattagtctggcttctaatctgcacatggagtgcgtgagcactgcggagcatataagtgaatcttgcaatgatgaagcgctcctcttacatgcaattcaaatagaaatgaaaatctgaagcgactagatttgcttcaaatatgaacactgtgccttaagagtacattgtaatttttaaattttgaattggagctgcttccagaatcctgcttgaagaccttgctggagatgtgtggtctccaaataacccaaaacaaagtagctggttgtaaagatatggaagaaagccaggttctaggaagacagactaagacaacaggttctaggaagaggcaagggaccttggaggtcccaaaaagctagtggtcaaaaatagagctggaatacataaaggtcagtatcagtgtaaatcagactagtctttcttagtgtttctcaagagtgggagagctagagaagtatttgctttgcaaagggcttccttggcagactgcttctggagttaacagagaggctgtaatgatgtcgagaaagtaagtcattaagcaaagtgtgatttgatactttaaaaggaaaggtggggtgtggcggctcagctgggctcggtggctcccccctgtaatcccagcactttgggaggcccaggcaggtggtcacctgaagtcaggagttcgtgaccagcctggccaaggtggcgaaaccctgtctctactaaaaatacaaaaattagccgggtgtgatggcacgtgcctgtagtcccagctacttgggaggctgaggcacgagaatcccttgaacccgggaggcagaggttgtagtgagccaagatcacgcccctgcactgaagcctgggtgacagtgcgcgactccatctcaaaatgaatgaatgaatgaatgaataaataaataaataaataaaaggaaagcagaattttattgtgaacaaatcctaatgggttgttcttactggtttagaaatgtgatctcagcctactcactcgtgaaatatctctttggtcctcctaatgcaactccaactataattaccttttttttcttcatgaaaaagcctttgtgaatgtagtgttagatatgctgaactgtatttattattcatttaagcttcattaacgtcatcataactgagatatactttctctaagtgaaagaaaaactagatagtattcagaacagaacttccttctggtgtatccctgttatttctttctcgtagtctcaaacatactaatatttctctgcacagtagtgatttgtggagggattcaatgttctataattactctaaactgatagcaaaatgttgtgtgcatgtacattttcccttttggagaggaaagtaataaggcatttgaggactttcctcccccaaagggaagaatttgataactttcatcaaattctcaaaggggcctatgacctgaaacagattgaaggcctttactaaaaaatcctttaagactctccaagacaacatggtgaaatcaaccacatttgtctttcactacgtccgttttccctgtgcctgtcctcttatacacagttccttcatgatctctgctagcttcccttttaaaaaaaaatgtctacagtcttgcttcattataaggccgatgctactatcgacagcttaaaatggtattcatgatgttttaaacaagttgagtgttaaagaactgatatagtttaatatttctccccttcagatctcatactgaaatgttatcctcagggttggaggtggggcctggtgggaggtgtttgggtcatggggatagatccttcatgaatgacttgatgcagtaacgagtgacttcccattctattagttcacaggaatgctggttcttaaaaagaatctggcacctccctcccctttcttgctccctctctctccatgtgccactcctgctccctcttcactttccactgagagtaaaatcttcctgaggtcctgaccagaagcagatgctggcaccatgctttttgtacagcccacagaactgtgagccaagtaaatctgttttctttataaattacccagcctcagatattcctttatagcaatgcaaaacagactaatacaagaattaaacccctaattcatatttcaagaagtagtctgtttcaggggaacattttataggtagaaatctctaccactgtgggcagacttgtattttttaaacaaaaacaaatgattatcagccttaattatactctgtttttttttttttgtttttttttttttttgttaaagttctaatgaatgttctttacctggtaatcatcaagtctaagtgtaatattaattcctggaacaagatcacttgatagaaatttaaaaaaattcgaggttactttaacttcaattttacttgtgaggacaggccattcttaatgttaaatcttcattctccgctaaagaatagagaacttttttttccaggaagccttaattgttgagttccattttctgctttctcatcgaataaccatttcctacaatatattatctaaattaaatagtaacaaaagtaatttccaactatataagagcttctccttttttgtaaaacacaataagcagttcttttaacttttatctatcaaatgcctactgtgtgaaaaattataaggtccagtgagataaataatatgaatgttttgtaacctggtaatactatttgacatttaagttagattgagaaaagaagaaatagtattcaacagatgctatgggtgcctcatccagattccctttatcaggccaggccacctaccccctagcttctgtggtgctgaatgctaacagttcacattcacttctccagaggattgccccattcacaaaagtctgggaagctctgcctccatttcccagtgtgctccttggcaaaagtcttatcaatatggagatacaaaagcccaccttgcttgctttctttaacgtgggaaaaacagtgatacagttgatgctccagagctccctgtgggatcaggctaaggctagtcttctaaaatcttatctttgctcggctctttcccctgccctgtctttctaaacccacttcctgacaggtttctcccgaaaaccctcaggaaataacttacaaaaaaatccttatctcaggctctcctttcagggaatctgactgaagacagagtagaagcagtgcttttacaaactacttttttttttttattctatagtaattatataatcaccaaactatagagttgccaaaggccttaggatttaccatctttgcctgttacatatgggtaacgaggcccactaagtggctttagaaaaagacaaaaaatagtttaggacagaacataaacacaggtctgctgatttccatccctgtggccttcaaatgattattacagttaagactatgtacttccttttatgaatccatgaatgaggagtaagccttcttatataaatatacataaatttgtttattcagcaaaggattatgaaacaaagtcaaaccattcaaatttgcaatgtttagtaatactctggagaacccatgttattaattactggcaacattttgccccctttcgaaataaatattttattccatcagcctcagatttttaaatgtttcttctttttcctttttttttttttttgagatggagtctcacattgtcacccgggctggactgcaatggcgagatctcggctcactgcaatctccgcctcctgggttcaagtgattctcctgcctcagcctcctgagtagctgggattacaggtgtgcaccaccacgcccagcgaatttttgtatttttagtagagacgggggtttcactatgttggccaggctggtctcgaactcctgatcttgtgatccacccgccttggcctcccaaagtgctgtgattacaggcgtgaaccactgtgcccagcctgttttttctaaaaatacctcagacttatctcctacatatcgggaagatactgagtcctatagaaatttaattatcatgcaaagcatgcctacttgtgttctagtacacaacctttagactttgtcctttttctgtgatcctttttaaaaccacttaagaaaaactgaaaatgttgccaatgttaatacctattaacatcacatttgcttattaaataagaaaagtatgtgagataaagcagacaaaagcaagatggtcaaccttgttaagtacagatactgaaggagaagctttttatctcctataaggcaaagttggcatgttcagcaggccctcagcatcccctgaaatgaacccaggttgcatcttatcattctgagtgttggagcggctgttgataatgcaatctgttatggcaagctaatagttaaaggctaaattgctgctcctgtccttctgtaaatgtgagtgcctaactggggccttatggaatcacagacagctctcctaagctgacaggtgaagtggctttaatagtagccagggcctagagaggccaacaaactgtttacacagacttgccagcagggggagcgcttaaaaatatgcctgcgcaaactgcatctgccagggaaacacttgcttaatgcagagaaaattaagagcaagtgctttccaatttcaggcaaagcatatacattcgtaaagagccagaagagcaagtcagagtgggccagtgagtgctaacgatgtaagaaatctttggcagttcttattcacagagcagtggcagagaatcagagagacaatctggatattcccaggatgtcctgagctccagttaaagcatagctttattgattgaactggatagaaggcgtcaggaattgaggctttaaaattgctgacgttttgtaatttctcttcaagtaaaattccaaaatgattggatcttccatttatggagttttccttcactatctatacacagccaagtcaaagcccttgtttctccttttccttatctcacacacttaagtggtttttctaacaaaccctgaagttcatactgtcagatgttgatgataacactttaggtttctgtgaactgggaatagcaagcatcacagcaaaaatacaaattctgacagtcttatatagcacagaagaatgattacccagatattagcagacaacatttcaacatttccgagtctaatggaatgagatttggatggagggtggatatcaaaaattaacaagaccaagtcaggactgatatacaatctgggagaatcctgagtcctatagaaattcaatgattatgcaaaacatgtccacgttgctaggtttttattattttgcactttgctaagtcatcgctacgttgagactgacctcaaatctaaaattaaccgaggtacaccacttgtaaaccaataagataatatgtgttcaccccaagaaaagatgatgatctctagtgattgattagctgttgcttacttgctgcgagtatgaagttgatactgtctaaactccctttttcccctagcatagcataaagaatatcctacaaaattcattctgacctgaagtcccatgattccttcacgcggattcttctgaaagaacagactatagtgagtttaagcaagtatttgtatgggtgaagtgtttcttttagggatcactcttacatcttgcagtctttcaactttctcttgcttctcacttcccagatatgaatatgtaaatggaccagaaaagagtggggtagctttctgactttataacttcacactgaagataaaggatagatgcgtgatagtattttctccttagattgccaaccatttaaatgccaaatcttctcccatcttaactcatatgagaataataaaagtcatttaaatggaggttgccatgtgttcatttattcaagaaaactttgttgaacacttagtaagtacaaggcaccatattaaggtagaaaggtgaataagataagtacagctcttttcttcattgagcttatggtctagcatccttactaattcagtatctaaaatagctaatcacttgggttgtataatttagcatccattagaagcactccaagaggcttggctggggggcatttgtaggtcactcaaatgaaatgttaactccttctaggctttatttagcaagtcaaacttaacaccttcaatataggcaattaggatcaaaaggtgttaaagcacattcaggcacaaagccatctatcaaattaaattacttaatctttcaactagttgcttttaaagtaaatgaccctccaaagttagtgggcattagtgtggcctaatgttcaaatgcagtttaaaatctaaatgctgatattctaaacagatcacactcaccctcccatgaaatgtatccttgattttagacttttccccttaagagatgtttaaaagtaggtatctcctctttctacagagaacagggccattttttttagagtagtcatcagtgtgccattgtaagtggaaattgtgcattatgaactgaacaattccaggaattctatgtctaaccttgggttctcccaaaagtatatcacgagacaagaagtgggttcaggtagttaattataagaagtgcatacaagaaggcaggggaagtgagacagagaagggaaaaatccctaaaagaattttaataagcaggttatctcagtggactcctaggcctcagtcctattgaggaccctctgagcaaccatgtagaacgtgcttcagaataattccatcagagaacaaagtaatatgaaatatttatctgccaactctcagccattatgggttgcgggtaatccctagggcggttaagtttcagaggcttctaggcttcccaacaagcaggctgggcaagctgccacagttgcagagaaagcccttgcatggagaagcagtgaaaacaggcacttgcagtggaaagttatcagcatactaggaagtgttcactacacctacatgtttatttaaaggtgggctgaggggatatgaggcggagcatccccagcattggtacaccctgcaaattgctgtaaactggatttgcttaaaaaagaaccatgattagctaacatttgacaaaatgttggtccataggcttatttggaaacaatactttgttttctgcaacgcgtccaaagaaaatttgtgtacatgtagatttatagcacttaaaatcttatcacagtaatgtttatttcatcgtatcaaaaactgcatatcatcatttcttcttgcccatacccgtgatttttctgagggctaagaggaaaagggtattcaatggagcagttcgcctctacaacagagaaaacaagggatgttaagttcagggtgccattcatgccacatttattcattgatgatagtaataccttgtgcttctttaccagcttttcccatttggcctgatgacaacatccttggagtgtcagagaagttattatgacctttactttacagctgaagaaactttgttttgttaaaaccatgaattgtgcacttgggatgtactctatattgggttagatgttctcccttaagatagttcagttaatcttgcccagaaacttgggtatttttgtccttgttttagggatgaaaattctgatcagggactggtggagttcccatgaggcaagaaagtctggtagcaagacccagttcctgaagcttcaacttcagtgttcattcccctgaaacacttgacctttccaggttgtcaccagattcccccaacgttccccaacagatatctagtcttacatgttacaactttcataggaccttgcatggtaccaaatttgttgagtgagtacattctacacaatcacaacacactgaagatattttttatctgtgcaaacttgacctccatccagatgagagctgatttgattaaaaggttcatgagacaacacccgctgatcaatcaatgttttatgtaatctacttccttctgctttctaccagctttcacttggttagttacgcctgggtattctacttattgactaggctccaaggccacatgtgaactggcttttccttatgtctacagcctcatctcacagggagctccctctcattctctcaggtgtagccacattggcctcctgttcatctctcttacatgccgtgctctgtgtcatcggtgcagcattgaacatgctgtttcctctaccaacaatgttgttgccctttgtcatcaccaagtaaactcctgcttatgcttcagatctcagctcaagcatcactttttcagggaatcttctctaacttatcctctgtagactctaataacactatgtgtctctttgttgctattattagaactttataatttatgtgtgtgtgtgtgtgtgaagatttaatcaatatgtgtctctcataccatcttgcatgatccattacagcaaaatccttatttgtttggacttaccaatgtaccccccagcacctagcagccagctaccatagggccttacacatggcaagcactcagtaaatatgtcttgaataaaatatatcaatctatgttaataattcctctgagttggacctagagtcttgttctcagccctagtgtttctcacttaggaaagtactgccccaccctgggggcatttggaaatgcctaagggtgttttctggttgtcaggatgactaactgcaactaacgggatttggtggcagaagggataatgatcatgtcacgtgtggatagtctatccaaggaataattgtttcacccaaaataccagtagaaccctgtgaaacactgcaagaaagattatgtattacaatagtaggcatctaaagtgtctaaaaattgtggagtttggggcttttaaaattctttatgatataactatacatatttatggggtacagtgtgattatttacatgacttatacagtgtataggcacaagtttatgtgtggatgtgcatatgtgtgtgtgactgctctttttagttaatcttatgtcaattagtaattagtttacagattattttcccaagtggtgtcagaaagaagggctgcagggaagcagaaggaaatggcgataggaaaactgtctgacagatcagaaatgttaaacctaaaaatgacaagggggggtcccatgttaatctgatttatactgctgatatttccctatatatttcctaagttctttcttgcttttctatttttatctggcttcttatttcttctccaggttaactccccattctgacacgttcatgtgtttgctttcttccttttagttcaaacagagaattgagattaattttctgtactgtttgtgtccagagtcacagcctgtggttgcgatagagaagcttgctaaagcctgtgtcagtgtttctgttataccatgagagcagtccaaatgtcagtggtaaagtttcctttactagactgaaaaaaatcattttcatcatacctttcctgcatcagatgcctggaaaaatacggggcagagatgaaaactactgtaagataatgggacaaagcactagatggggactccagacactggggagccctactgaccaactcgaaatcatttaacctcttttgaccttggttttaccattttaaaataatcagaaggccagacaagatagcctctagggtccttttctgatctaaaattgagttttcaagtttgacaagggataagggaggagaaaaaaagatataggagatgttatcttggaaactaggtaggtgtatgccttaccatgtatgaaattgtaaatcatgtcttatttctttggaatagtacagaagcttctattctggaatagaacagctagcatactaccaagacttttcaaggagcaagaatggagctccctggagaactgactgaacatggcttcagaggcagtatccatgtaagtaactacataagagtttaagtgggccatggggataaacccacgctttaatcccactttctgactgtcttctatacaccaggcttgtacttatccactctaaaccattgtttcctcaagtggaaaatgggaaggatggtagcacccacttcacaggattatggtaactaagtgaaaaaatgtcacatgaaaacatgtcttagcacatggtaagtgctccataaataattgatgtgattactataagcaagctaaactgatcaagaatggaaccatttaataaatgattctttggttaccagaattctgcccccactgcaacccacctcttccggaatggctgataaatgcttgcatgaaatagccactcaaatggctgctaccagtcaaatgctgataaaagatatatttaaaaggtattacttattactttttattgaaaaggtatgattactttttataaatttatttctgttcttaaaactgctacagatggttctgacttttgaattaatcacactgatctaggaaaaggccacatttactgtttagtctatcgtggattatggagcctcatgtgactcactgataattttcttttattattccttccagagacatagagacaaaaagtgccctcacttttactgtattttgacctggaccagtctacatttatatgaatagctacaaagcagctttcagcacaaggctgtagggtaggttcagatttggcctctccattaattagtaagtaccattagctgggcagacagctgccaaagggactttctccacactcccatgagttggtcacagagatgttactgtacttttttactcatcaccatgattaattgctgcacttagttcataatttcccctgggagttaacccctagcttgggataaacactaaggttttgtcaaatcctcccattctaagattggaatattgttgcatcatcctgttggatgattcaggattttaaaagttcagagcactctgatattccgacaattatatacacattgttttcagtcttcttctgctttatgatccttgtttatatttctttgtgtcattctttttagtaattatttccatcgtttcttaagcataaacatgttctaactggctgtgcggtagtgtttcaatagagctcgtcatttctaggcaagctcttctaataatattttatatttttaatttatctccttatattttgctgtaatatgggtttcattgatttttaaaatgagttttgtttgttgtaatataaggttaattctgttatgtgccagaattatacatttgacagttttccatggaattatttcaattggcaaattaaataaactcagactatagcctcagtattagtattcttaatggatacactttttaaaagtaaagacaaattccctgacctaaatagttaggcagaaaatgagacatgtaaagtaaaatcagtatttcgtttctttgaaactttattgtgacttgaaacagtgcaacaaaatatcagtctaatgccatattactgattttaccagtgctgtaatttttaaataataaatgtatactttactgattaatgacttgagagctgcttactcttcatcaacgtaaaactgctcttcaagtttcccattccacctctgcggtatcacttactttcaataagctcatctctcatttaatttaaaatgtaaggtagtacattcaatagctctctacatcaattgtttttaactagattaatttatgcctatgtaagtataaataaggccttgaagttgcttgcgtgataaataataaataaaatacaaattgttgaacagatcaatggaaaaggaaataagagtggattaataaaataaaaccagaagatacaattagtttaagaaatgcctactgtaaaatcccattaaatcactagaagtagaatgtagatttggctctgagcttcccagtagccaaagcaaaaagaactgcattatttgcaaggttgactgtttttgtaatatgttttaaggttttgtttcacaaaaaaccatcttttcctgatatgagcatgaagagatatttctcttgagagtcctgatgaacagcttgttacaggatatgaaacacattgtcctcaacgtcactctgacagtaatttcgaagggaagtttctgtatttttgtttctcaaaaacgtgaattgtagcagtaatgccaaagcaatattcagtaacaccagttttacatgtaaccaaaacaatggaatacaagtttgggaacaatgacattacatgttttatccaagaataatatttggctactcccgaagaatgaatgacctttatattcttcattcacaaatatatatttatgtgaataaaaatagaatacaagtacaacactattatatttttatttattcagtcacctgtgatttggggttcaaagtattgacaaggacacctgaatttttctctaatatactctgagatggctttttttgaagtgtttttgttttgttttgttttgttttgttttgttttgttttgttttgagatggggtctcactctgtcacccaggctggagtgcagtggcatgatctcagctcactgcaacctctgccccctgagctcaagcgatcctccttccccagcctcccaagtagctgggaccacagatgcacgccaccacacccgactaagtttttgtatttttggtagagatggcatttcatcatgttgcccttgctggtcttgaactcctggcttcaagtgatccgcccgtctcagcctcccaaaatgctgagattgcaggcatgagccaccacacccagccagctttttgaagttttggtacagtaattacctggagtaaacaaggtggtgatacaggaatacctgaacagtgcagaaggcttaaggaagtaaaaggttagaatagatttattttgtgataacagtgaacccaccacctgaccgtattccccagaggggtcataggacagttccttcactcaggcaataagaaatggcaatgatcaacgaaatgtcctctgaaggctagggtagacagaaagacatgctgccatgcaattggacctcctaatatcaatggagaaaagagggaaattccggaatggtagaggccaaaagcaacacttaaccttcagaggcaaggcagtctttgtctcagatgctgatttttgggaaaccccaagataagacaatgatgaaggcaaaaaccaactcattttactggattattttatttgtattgctacgtaataattgtacatatttagggagtacatgtgatattttgatacatgcatacaatgtgtaatgatcaaataagagtatttaggatacccatcacctcaaacattcatcgtttctttgtgttgagaacacttcacattttcttttctagctattttgaaatatacagtaaattattgttaactatgcaatatagaattacttgctactttacttatttcttagcacttacaagtttaaattcacttaaaatgttatgacctagaaaggcctacatattttcattatgacagtacagcacttcatcatttagtaagtcttttttctggtttcttctccctacctccccatttttaataattgaaaccactttgcttttgatcatcccaagcacttaagtgacataagtctttcagctgctggatgaataatgtatttataatattcataactgcgtgtaaaataaacagctcatttgtttctattaacgtagtcgttttgaagtctgttcttcctctcagattcttttgccaatttagaagtgaaaatatatatatagaaattgattcagtcttaatgactcccacttaattcttcaaactggaaagtagctgggtaaatgactcactatggaactatttcttaccattacaaatgttctccagctactctcagtaaaatacctttataaaacacctaatatgtgcccagtataatgctaatttaaaaagaactcctggccgggcgtggcagctcacgcctgtaatcccagcactttgggaggccaaggcaggtggatcacctgaggtcaggagttcgagaccagcctgaccaacatggtgaaaccccatctctactaaaaatacaaaaacgttagctgggcgtggtggcgggcacctccagctactcgggaggctaagacaagagaatcgcttgaacccgggaggtaaagattgcagtaagccaagatcacgccactgcactcctgcctgggtgacagagcaaaactccatttcaaaaaccaaccaaccaaacaaacaacaacaacagcaacagaaaacaaaaactccttaaagctactcaggattggatataaattttatatagacatccccaaagatgtaagtactgagatataatccctgaaaaaagatagttacatacatttggatcaacaaaagtgtttgactatctttgccctggcctcaggtaggtctataagaagactttaaggataaaccaaaggtaataataaataagttaacatacactggaaggataagcactgggaaaactgagcaaggagtgaagtttatctttaatctccctcttcccctttctgtatcttctagtatctgagatccctgctatctgtcaaaagcctattgggcatttcattccagaccagtcaccccctcagtaaagctttacaccataataggtgtgtgttaggagcttggtgccaggggatcttgaaaactgagagacctctaaaccccaaagctatgattctgtaatggggtgatttcaagcattgctgcaagttaaaattttagggtaaaaaagcattattccttaggatttgccaagcactttttgtacctagaggcaaaagagccctaaaatcacttctccatgaaactttctttgacacagaaacttagaattgtcctgttaaatcttaacagctaatggtgatcatctggtggttgtgtgattttcttataaaacacagcttttttaggattgtttgagttttccagtgtgtctttcttgcaagtatcctctcttatttagaacataatcttggcaagaagctgtgtgactatttgccttgacttgcttggaccaaacacaagcagtcaaaataaatttaaaagatgaaaatgatgattcatttgaggtatttttttaaggtcctcgcatgtgtcctagaaactaggttctttgacactatttcattttgggggtcaaagaagagaaagctccaggatctgtcaaattagtttttaaaggaatatgtgtaagaaagctagggaaggattttttttccccagtaatgtatgccataccacatttaaaataaggagcagtaaatgcatggagtaatattttgtatgcacagatggatatataaattagtacctcctattttaaatggaatgcttccaaaagtcttctattcttccttcctggaacaggcagttcagggatgacatagagactaatagatggagtgttttagaagggatttaagcccggggtgaatggttggactaaccgaccattaagaccatttccaaaccagatgttctatgattttatgaaaccatatatgaagcctattatcatgtttctaggtttctttttcaaaattaattatattaagttcacaaataattttcctagcatgcttcacattgtctcaagctatgatataatgtttggttgagttttagttaagagaccatgtgcgtttaaaaaaaaagatatatacatagtacctaaaactaccagaaaaacagtgatgactggaaatctcacttattaacatctttagtagaaacaatacatggtacagagggttaaagaaagataagacgtgtatgcttatggagaaaaggggtcacgctaaccaagaacttttttatttttgaaagacacaaggtaaggtttatgacagggagcccatcagtcttaaaatcatgctttctgactcaaatctaaatatcagtattgaatattgtgttataatgaataacacttgcaccgccttgtttgtttcaaacaatatgatgttatcaaacaccactctcagtatgtcaataaatacaattgtgtatacttcagttatacagagagttaatataagttcaataactggcatatttgttattaaataggattgtaataacaggtcttggtgtttctggactgtagcacagctaggtgaatcgtcctccctgacattgagcatcaaaaagtctttttacttgccactcattttgcaaggtctcaggggacagacgttttgcaaactctgtgaaatcttaataacagcctaaaggagagattgcaaatgtaaatgaacagccacagcccctttaaacatgactatatcacacagatgctatacatagcagctgaaagccaaataatggtttgaactgaacatgactggacgattaaggtcaccttccgcagctttataagcagtttcttattataatggtcttctgacattttttctcctatgacataattgttgcaagaggttgacattctcattggctcatgggaacatttccttctttcatttgccttttagtcatgtgtctgaacttttatttggtatttcctctttacagtgaatcctaatatcaatgagattcaatacaataacttttctagaacttgattgaaggtattggtgtttttttcaagtatttgctacttattactggctataccttttttctttaaaagtatacttttctatttatgatggacaatttgaaaaatataagaaaatgatcaccatgatctcatgatccaatgagctaaaatattgtattttaaattctttcagaacctgttctatgcatatatgcatataaaaatgaagtttgacttactgcaaataagtttatcttgcttttgcctttttatgattggttattttatatataacaagaatatcatacacacgtgagatatgtgaataagggtaatataaatacccctgaactcacaatcatgcttgagagatgcaacatttgaagttccccatgggcaccctatattgccctctccaacactatccccttctctatcccactccccaaagtggacactcttctcaatgtggagtgactgctctgtcaattttctttatatttttgctacactggcatggtgactctcaaataatgatactgaactttaggaaatcttctgcaactttttttcactcaacattttgtttatgagaatcatccattttgaaatatatgaacatttcacttctatatggtattccctattgaaaatataccatttttatttatctgtttcatatcaatggatgtttaaaagcattagtatgaacacttccctatcaatggatattaaaaacaacagtggtatgaacattttcacccatatctcttaatgaaaatgtgcaagtgtttccttagggtctaaatctaaagtgcaattactgggttgcaggacgtgctcaaaattcaactttattagataaaaatattttaccagaatggttcttccaatttatactttccctagtagcataaaagtgttcctgttatatcttgcttttatcacttaatatgattagctttttctcaagttcagatggtctgtctttctctaggctctctctacctcatcaaaatgcttgcacaatcatgtgattttcctccatatgccaaatcttgagtagacagcccataggaggctctaagcaggctaatcaacatggagacactccagaaatagttgaaaataaggcttgttgccaaatatatgaaatatttttgctcatctctttgtacagtagtctctcaggatgtcttttgagtaccacgcatacatatcctccatacacatatcctttaaatatagcttaaaaaccatagcagagcaaattgtccttcctactatatatgtccttgtttatctttcttcatctcttttcactttatagcactggtagcaactggtaaacagtacaggatatcaacacacaatttttgttgtaaaacaacggataaaaatctgtttgttcaatcagaagtaagagtgaaaaaaaataaggttgactcagggtcagcatagcaaatagatggcgtgctctactggaaaaactgaggaaagcttaatacggggcatactggcaattgtatgagcaggattaagaaggggaactaacaaggcacaacagagtctccagactagcaacagtggggagccattaccaccacttgggcctgaagatacagcaggagggaatgattactggcatggaggaggagtagccttcaggagagaaaaggagcccctgttaattttgtcaaacaggaaatgagcaaggaaaataaatatcttcacctcacactcattcttgttgatttccagtaggtttttttccattggctccacccaactgaatgtcagagaacaagaaaactaatttgatgtgatccctaaaagcataaagcagggtggaacaagttggagcgtagatatagaagttctaggaaagtaaaaacatggtgattaattaataaacataggtcctttggtttttctcaggtctgattttgtatctgatttttttttttcagtattgacaggaagatggtaattaaagatattagaagcatggacttttaagtattgccttgaaaaatgtctttgaatttgtacagtagctaaaatcagctctcagcataactgctcagtcattttgttttgcttgacacatatctgagattatgcatgttataacaagcactctggaattaaaaatcaagccaaggggttttgtttgtttcttttgttttgttttgttggtttgtttgttttcaaatcaaaagatagcatcttgaattgccccattataatacgctttcattcatgatgtttggattatgtgcatagtaaggtctctttataacctagccttagtgataaaggatgagttttatagcattttaaaaatctatcttttcaatttttatatctttctctagcaccaacagtagcctagtgtttccggatgccagagaaagcctttagtggcttttcacagtagtttttttttagatccatttcttctccaggtatctctcccttcaagaaaatgtgtctaaagagctccatggaggaaagaactcaggatactttacctaaaggaaaaggactaagagaaaccactcattttaccttctttgttggatgccatgcttgtacagtctacaaaactatgagccaaataaacctcttttctttataaattacccagtctcaggcattcctttatagcaaggcaaaatggactaatacatcccccatcttctcattattcttgttgatttctaggttcttgacccacttaagttttctaaaaccaaagctgtgcctgattaagcacagaataaacaaatattgtttaatgagttcaacctaatggtatctagggatataggagaacatgtcaatatcatctccatttatttctttacaattgtgattcagcctcaatacaaatgaatcatatttgtcaagctaaaatgacattttccatcatttttctttagaatctatctttaatcttgcccctcttggatatactgtttaagtctactttgtttttatttcttagccttagagtgatattgctcctagacataattgtgaattaggtgaaatttgttttcaactttcctgaccttatatccttttagtatttcatttcctcttccttcttaccacccagtggtgtgctggtaaatatttaaacaactagatttcatgggagaaaagggtcctgatttataatatttgtagagcttccagggtgatgtctactggcttgcaaaatttctgaaaatttaacagctggctcttgtgaattggtatcagccagcttcaacataccacaaaccttattcactacttgaggatttaatgtggctcacacatactgcctagtccctcaattcaccttccctatgtctgctctaattctgtcttccaggtagtacaccatgttcttcctcagcaacttacctgccatatgtccatttttttccttcctgaccatgtcaagtaactgacaaaccaagcttggaaactgacacaagatgagatgttaatgaatgacagattcagtgggacagcatatcctcaaaaggacatttgtcagaaaaagaatgatggtttagaaatagcagtgttgaatacagactagggctaggcgatggaaggaataatatttgacaaagagtttgagaatacagaagagtttaccatgaaataagagttcccagagaacacagtgagatgatttgagaggaaggagaaatacgggagtaaaggtcaaggtaggcctatatggagcaatgtgggaataagagtttggaagagtttaaatgacccagggatttacaacctgggcaatgaccaaggataacatatatgtaagcatggcatgttgaactcaccttaaggcatccaaaagaatcaaatacagccattctgtgtttaattaggagtagatttgagaatatgaactatgcaccagtatactcagaagaaatcagcaatgaactggattgattttgtttccgagggagtagtaaatcaggagaataagcctgacatggcatttttttggttttcaggcatatcactactaggaaacagggtcagcctccatgggagaatttaaatttggtgtagaaatatatacagatttattatatgcttcgttggtgtaagctgtatgtcccataatttttacttagaggcccagtctctgtgcatggacactgaattgttgactgttctttgtccttgaattcagctcttgctgactcttgagagttttgctccaccttcatctcttctctttgtagactcctcgtctgataattttctctttgactttaagatttcccttattagggaaataaagtgtcttcatttgattgtattttgcaagctagcaacagccctgtgtgtttcctgttcctacttttttaacacccaggatcacaagaaggtttttacgctatctttttccatttcctttccagtcaattccttattattctttgaaactctgctttgcttcttcaaggaagcttatttctctgaaatttaaaaaagcacctcattattgagaaatcaaatacctttaactctgtaaatttttaccaagattttctgctgactttggcattaatgcccactccctcttctatactctttgctcatgttcataaaaaagtcttctatcattattctcttttggcaaattcaatgaatatttaaaatcactccactttatcctctactttacttatctgaatatttccaattcttgatcaacaaccttcctacaatgattaaactttaacctctgagttcaagtgttttctccttaattcccaattctatcttctctcttaaattacatagctaaatacttataggaggagaatagaggaaacagatatgctagatgtggctagacttctactttcgtagatttgctttggaaccgtgtaaatattttgcctaattgtaaagaaatattaataattttgaaaggtaatccacaaatctcaaaagaaaatgaaaggaatgaatgtaacaccattgataatcattttttaatattactcagaaatggtcatgcatatgttgtgagataaagttaatcattatactgatgtcactgagaacccagacatctctcatgagagagaggagaaacatgtgtacgtttgatgaggttaaataaaagctcttcagtccttggtaagaaaaataatcatggcagacgggaggcaggactagattgcagctccagacagagcaccttgcagaagctcacattgggaattttagctccagatcaactgcaagaacaaatcagcaatcccgagaggacccacagaccctgtgaaggaagccgactgctccttcaaggacctgggagacaccgcaaatactgtgagtgccccaactgcggaaatgggacagggagaccctcctctcccaaacacacacccccactggagaagccaaaggtctgtttgtgggagaagtttctgactttaactggggctgagtcaatttacagccaagtgaaatacaggggaagaagaagcagcagaaaggacctgggagcttgccgtgtcccctagcaggccattcctgcctggaaccacagggatccatcaggagggtgaccagaggagcagcgggtacaactccataaggaagaaatctctagctgaactttgtaacaatttgaatgggccaagaagcctcctggccagaacttgggggagggcacaaatctggtctacaggctccacaggcaggggaagaaccaagcccttcccccgcaccccctactgcagctgggaggcgggtagcccagggcaggttttcaagcgcattacaccctgcccctagaaacagactcagggctgttggggcaggtgcatggtgggaatgcaaattgcccttcggtttatgtgggagctgggtgaagcctgtgactgccggctttcccccacttcccttacaatctgcatgactcagcagaggcagcagtaatcctcctaggtacacaactccagtgacctgggaatttcatccccatccaagcagtggcagcaagacccacccaaggagagctcggacacgcctagccttgcccccacatgatggtccttccctatccaccctggtagcagaagacaaagggcatataatcttgggagttctaggggcccgcccactgccagtccctctctacagctgatgctttccagaaagcaccacgtcctggtaggaggcaaaccagcacaaaaatagagcattaaaccaccaaagctaagaaccctcacagagtccattgcaccccaccccctgccacctccaccagaacaggtgctggtatccatggcaaagagacctatagattgttcacatcataagactctgtgcagacaatccccagtaccagcctggacccgggtagacttgctgagtggctagacccaaagagagacaacaatcactgcagttcagctcacaggaagccacattcataggaaaagggggagagtactatatcaagggattaccccgtgggacaaaagaatctgaacaacagtcttcagacctagaccttccctctgacagagcctactcaaatgaaaaggaaccagaaaaccaatcctggtaatatgacaaaacaaggctctgcaacaccccccaaaaatcacactagttcaccagcaatggatccaaaccaagaagaaatcctcgatttacctgaaaaagaattcaggaggttagttattaagctaatcagggagggacgagaaaggcaaagcccaatgcaaggaaatccaaaaaatgatacaagaagtgaagggagaaatattcaaggaaatagatagcttaaagaaaaaacaatcaaaaattcaggaaagtttggatacacttttagaaatgcaaaatgctctggaaagtctcagcaatagaattgagcaagtagaagaaagaaattcagagcttgaagaaaaggtctttgaagtaacccagtctgacaaagacaaagaaaaaagaatatgaaaatatgaataaagcctccaagaagtctgagattatgttaaaggaccaaacttaagaataatcagtgttcctatggaagaagagaattctaaaagcttggaaaacatattcaggggaacaatcgaggaaaacttctccagctttgctagagacctagacatccaaatacaagaaacacaaagaacacctggaaaattcatcacaaaacttcttcacctaggcatattttcatcaggttatccaaagttaaaatgaaggacagaaccttaagagctgtggtgagacagaaataccaggtaacctataaaggaaaacctatcaaattaacagcagatttctcagcagaaaccctgcaagctagaagggattggggtcctatcttcagcttcctcaaacaaagcaattatcagccaagaacttgtatccagtgaaactaagcattatataagaaggaaagatacagtcgttttcagacaaacaaatgctgagagaattccccatgaccaagccaccactacaagaagggctaaaaacagctttaaatcttgaaacaaatcctggaaacacatcaaaatagaacctctctaaagcagaaatcacacaggacctataaaacaaaaatacatgttaaaaagcaaaaacaaaaacagaaacaaagtacacaggcaacaaagagaatgatgaatgcaatggtacctcacattccaatactacattgaatgtaaatggcctaaatgctccatttgaaagatacagaaccgcagaatagataagaactcaccaaccatctgctgacttcaggagactcacctaacacctaaaaactcacgtaaagtaaaggggtggaaaagggcatttcatgtaaatggacaccaaaagtgagcaggggcaggggcagctattctcatatcagacaaaacaaattttaaagcaacagcagttaaaagagacaaagagggacattatataatggtaaaaggccttgtccaacaggaaaatatcacaatcctaaacatatacacacctaacactgtagctcccaaatttataaaacaattagtaatagacctaagaaatgagatagacagcaataccatatgctgtctggctaagttagttataaagtttatttagaaaaaatacctaagaaaatcctaaaaaaaagtgcaaagaatagtggcgggtagaccacactggatattaagacatactataatgcctcaataactaaaatggtttggtattagcacatggagaggtagactaataaaacagaaaagagttttataataccagtgggggactttaatactccattgacagcattagacaggtcatcaagacagaaagtcaacaaagaaacaatgactttaaactatactttggaacaaatggacttaacagacatatacagaacatttcatccaacaaccgcagaatacgtattctattcaacagcgcatggaatgctctacaagatataccatataataggccataaaatgagcctcaataaatttaagaaaaattgaaattatatcaagagctctctcagaccacagtggaataaaactggaaatcaactccaaaaggaaccttcagaaccatgcaatctataatctaaaagagacatatcgatcaattgcaatgtgtgaacattgtttgtatactgattagaatataaaacttttttaaaaattgaggcaattggagaaatttaatcactgactagatattttatactaataagtaattattgtaggtttttaggtgtcaactaagttttaaaagctatgttttaaaaacagtacttatctaaagtatatactaaaatacatatggattaaataatatgattttcagatttgtatcagtataatctaggaagaaggaggtagattctgttttagatgaaataatattattaatgaagtgatgattgttgcatctgggaaatgggtatgtgggggttttctctaagttgatctatgaatttaatgaaatccacataaaagcaccattttgttctgaagttagctaagttagttataaagtttatttagaaaaaatacctaagaaaatcctaaaaaaagtgcaatgaatagtggcgggtagaccacactggatattaagacatactataatgcctcaataattaaaatggtttggtattagcacatggagaggtagactaataaaacagaaaagagaaatccagaaacaggcctaaatgcatatggaaatttagatttttttaaataatgatgacatttcaagtcagtgggaaaattgtcttctaatatgttattggcaccacagaaaaactacaacgaatatatcattggctgaatttctcacagagttccaaatggatctgagatctaaagtgcaaaaaaataaaaaaataaaaaactgttcaagtagtgtaagaaggcatagatgaattccttatttgctttgtggttttatctttgtttacttcttggagtaaggagaatttcccatggtaaatgctgtgatgagtccctcagaaccccttgcaaaggaagagcttattcctccagctattagaagtcctctgacccacacgtagtagttacaaggattcctaaaaaaaagtccagcacccttgtttccatctcacagattgcttcctggggaatctaacctgttgcatttccagtgattaaaaatacagaagcaagaccaggcatggtggtccacacgtgtaattcccatgctttcagggactgaggttggaagatcacttgagaccatgaggtcaagaccagcctgggcgacatagcaagactcagtctcttcgaaaataaaataattagtcaggtgcagtgtagtgtctgttgtcccagctactcatgaggctgaggcaggaggattgctagagcccaagagttcaaggctgctcctgggctctctgaaaacaaaaacaaaagcaagtaaggaaaatactaatgcatgtgatcaaatatataaagttttgcatagcaaaaccaaaataccacaagcagagtacaagccaggataattactttcaaatagcattgcaaattttatctctaacatttaaagaggtgctaacaattgagtggaaaaacatcaaaaatctgacttttaaaaagcaagatatgaacaatattttacagaaaagaagtataaatgacccttttcttgtgaaaagttaccaatttcaatcataataatggagatataattaaagctacactgaaataatgtttctcacctctctgcttgacaaaatccagcatagtctgctttccagtctgtgtggaaacacggctctcatacattgctgttgataatgatacaacggctgttgaagagaagtcgacagtatcagacaacactgtttattcttttagcttttgacccagcatttctgccaagatacgaatctatcccaaagatataccggcaaaaatatggactactatatgcccagagttgattgcagcactaattgaaatagcaaaagtttgagttcggccatattatttaaaagaaacaatatgaaaataagcaaaaactttaaaaaatgactctgagtggggcatggagggaagctagcagagaagacaagactagaagttagatctctatgcatgtaccttgctctataatgttaaaccttggaaccatatacacaaatggttttcataattataaaactcagttaaattggaaagaaaaaatcaatctctaaaaataacaaccaaacaaatgagcccaaatgtctatctagctgatggcataatcatgctgagaattacttcaagtgattttaagtactttgaccctacattaccaggtagatatgcccaaaggaaaaaataatcacaaagaaatattcttttacagctttattgaaacgtacttgatatacaaataactacatatatttgatgtatataatttgatgagtttggatatatgcatacatccatcacctccaaatgtttccttgtgtcccaaataaatcttaaactgcattcaggtgcattattttaaatactaatttttgaattgttatttcaagactatggtgtatagataccaaatagtagaataaagaaactaaataattattgctaatataatttaggaaagaagatattaaatagggtcatgcattgcttaaccgtggggatacattctgagaaatgctttcttaggcaatttagccacagtacaaacatcatggtgtacttacacaaacttccatgatatagcttactacacaccttggctttatggtatagcttattgctctttggctaccgatctgtacagcatgttactgtattgaatatcgtaggcaattgtaacacaatggtaagtatgtatgtatctaaacatatcaaaatatagaaaggatacagtataaaaatggcacacatatatagagaacttactatgaatggagcttgcaggactgcaggttgttctggatgagtgaatggtgagtaaatgtgaagacctaggacattactgtatactactgtagatgttataaagactgtagtcttaggctacactaaatttattttaaaatatttttctgcaataataaactaagcttactgtacctttttaattttataatcttcaagttttttaacttgactcctttttaataacacttagtttaaaatgcaagcacattatacagctgtacaaaaatatttgttttctttatatccttagtctataatctttcatcaatttaatttttttttttttttttttactttttaagcttctagacattagccaatgcctagaaggggttttctgatgttatctgctagagtctttatggtttcaggtcttagatttaagtctttgatccatcttgagttgatttttgtataaggtgaaagatgaggatccagcttcattctcctacatgtggctagccatcttaaaaactaagatgtaaacacgcaaattagcctagacctacacagggtcaggattatcaatatcactgtccttcacttccacatcttgtcccacttgaagctctccaggggcaataacatatgttgagttgtcatctcctataatgacaatgcttccttctggaacaactcctgaaggacctgcctgaggctgttttacagttaacttttttttttataagtagaaggcactctaaaataatgattaaaaatgtataggatagtaaatacataaactagtaatatagttgtttattaacattgtcaagtattatgtactgtacataattgtattgctagacttttatatgactggcagcacagtaagtttgcttacaccaacatcaccacaaacaggtgggtaatgcattgtccatggcattaaggcacctgacatcactatgtgataagaaattttcagctccattataattttatgggaccactgtcatatataaggttcatcattgacctaaatgtcattatgtagcacataatgtataagaaaaaagattcagaacaatcaaataagtgataagtaataagcctgacaattttaaatttaaatagaaaatgcctgtatgaatctgatttatttttatgcttcacattacaaggcaagaatgcccactcttaccactcctattcaacatagtactggaattcctggccagagcagtcaggcaagagaaagaaataaaaggcatccaggccgagcgtggtggcttatgcctgtaatcccagcagtttgggaggccgaggcgggtgaatcacaaggtcaggagattgagaccatcctggctaacacggtgaagccccgtctctactaaaaatacaaaaaaaaaattagccgggcgttgtggccggcgcctgtagtcccagctacttgggaggctgaggcaggagaagggcatgaacccaggaggcggagcttgcagtgagcccaaatcacgccactgcactccagcctgggcaacagagcgagactctatctcaaaaaaagaaaaagaaaagaaaaaaaaagaaaaaaaggcatccaaataggaaaagagtaagtcaaactatctctctttgctgatgatatgattctgtacctagaaaaccctaaagactttgccaaacggctcctagacttaatgaattacttcagcaaagtttcaagacacaaaatcaatgtacaaaaatcagcagcatgcctttacacaaataatattctagcttaaaatcaaatgaagaacacaatcccatttacaacagccacaaaaaaatgaagtacctaggaatacaggtaaccaagggggtgaaaggtcgctacaaggggaactacaaagcactcctgaaagaaatcagagatgatttcaaacaaatggaaaaacattccatgctcatggattggaagaatcaatattgttaaaatggccatactgctcaaagccattcctattaaaataccaacatcatttttttcacaaaaatagaaaaaactattctaaaattcatatggaactaaaaaagagactgaatagccaaagcaagcctaagcaaaaagaacaaagctgtaggtatcacattaccccatttcaaactatactacacggctaaagtaaccaaaacagcatggtactagtacaaaagacagacacatagatcagtggaacagaatagagaggccgtaaataaagtcacacacctacagccatctaatcttcaacaaagttgacaaaaataagtaatggggacaggactccctattcaataaatgtgctgggataataagctggccgtatgcaaaagaatgaagctggacctctacccttcaccatgttcaaaaattaactaaagatggactaaaaatttaaatgtgagacctcaaactataaaaatcatagaagaaaatcaagaaaatgccccgttcaacatcagctttggcaaaagaatttatggcaaagtctccaaaaacaattgcaacaaaaacaaaaattgacaagtgaaacctaattaaagagcttctgcacagcaaaagaaactatcaacagggcaaacagacaacctatagaataggagaaaatatttgcaaactatgcatccaacaaagatgtgatatccagattctataaggaactcaaataaatcaacaagcaaaaaacaaataattgaatttaaaaatgaggaaacaagatgagcagacatttctcaaaagaagacatactagtggccaacaaacatgaaaaaatatcatcactaatcatcaaagaaatgcaaatcaaaatcgcaatgagttaccatctcacaccagtcagaatggtgattattaaaaagtaaaaaaataaaaatagcagatgctggtgaggctgtagagaaaaggggatacttatacactgctggtgggaatgcaaattagttcagatactgtggaaagcagtttggatatttctcaaagaactaaaaacagaactaccattcaacccagcaatctcattactgagtatatactcaaaggaaaataaatcattctaccaaaaagacacatgtactcatgtgttcatctcagcactattcacaatagcaaagacatagaatcaacctaggtgcccatcaatggtggattggacaaagaaaatgtggtacatataaaccatgaaatactacgcagccataaagaagaatgaaatcacatcctttgcagcaacatggatgcagctggaggccattgccctaagctaattaattcaggaactgaaaactaaatacctcatgttctcgcttacaggtgggagctaaaaacttagtacacatggatgtaaagatgggaacaatacacactggggtgagagagagggaggggagtaagggctgaaaaactacctattgggtactatgctcactacctgggtgacgggatcatctgtaccccaaacctcagcatcatgcaatacacccaatgtaacaaacctacacatgtaccctctgaatctgaaatagaagtttctttttttaaaaaagaatttcttctgtgaaaaaaagataacatgaaagttggtaaatgccaaaaaattaaaaatgatcaaattaaaaagttaccattttacaacaccttttggaataatggatataggtcaaaattactgatagatgctaaaactattaggtaaatgatgagaaattttataatggatgaatcaggtttgcaaaacctcaacccacttcccattattaacatcagtaaaattgccttccatatgatgcaaaaagagacacagcatcacctattaatattctcaccaaagagaagaaaagccttaaatctaatcagcctctagaaccaactatcaactggcagaaaatatgagtatagaaaaatatgttaaatgaaactaaaatgatactatcagtaaaatatagaatgtaagacattctacaggataaatggtgccatttcttaaacaattaaatgatatgtgccaagaaaaaagggggtgaggggaattttcatagatggaaaaaaaactgaaagaaatatcaaccatgtgatgtgtggacctcatttgaatcccgatttaaacaaatcccctggaaaatgtttttgggacagttgtggaaatttgaacataaactaggttttagatgatatcataaggctattgttagttttagcaggtgtgacgataatattgtgattatattttaaaaggtatgtattaaagattcatagcaaaatatcatagaaaaatatcaagaatttgcttcaatatgtacaggaagaacaggagaaggaggagaaaaaaagtgaagaaaaaagagcagcaacagcaacatagggttagaagtgattaaacaaaaatgactacatgttaatatgttgatttctatgaagctgtgggaagagtgcatggaggttagttccgccctgcttctattgtcacgcaattttagaaatttctatcataaaaaagtttttaaagtatatgagctgagtggatgtttgacgttgttgaaggatccagaacttaacgaagagcaggggaggggtctctaatacccttgatgttttctcagacgacttctccttctagagtgctacttcccatggggctctcttctggaaggtcccccgctgccaggggagccatgctgaggactcatacccctagctctaatatttatttaaaattatccttatttatgtgcatttatttataattatcctcagttgtactttgctattttaatatacagctgtgttactagcattaaatgcatttttgacttaggatattttcaacttacaatgagtctatcagaatgtagccccttcataagtcaaggagcatctgtattaaattgtgtagctctatcttttctagtaatatcccttgtcttaaaacataattaccttgaaataaaaacctcaatttattgttttctatacctttaaaaatatttattttctacagatgtgtttatgactatatcttttttctagccttgcatcttatatttcagattttaaaatacatttcaaagtcactattttatatttgaagttgtgtagcgcttattttgaccttttatttccctttttgttttaattttatcttatattgttcttaatttcattttaatatattaatcttacgtttcccggttattatcttatatgttcgcctttttaactactatagttttcactgtactttaagaattttctttctggaatgcccagcagaagtggagccacgaggcaagtgacactggaaagagcccatgctacaaaaaggaattctaaagggtttttcttcacaggtatccttagagtagctccttggcactcagaaataataataatgacagatcccccattaagttcaaggatatctccccaaaacactttttctgtgcaactcagcagagaagctgttaagtctttcaaggcaaaagttaattctctgtgaggatggaatgcttttggtcctgaaatccttctgatgttacttggcaaccagttcttacataaggaactacatgtttcaaaatctacagtttccaatgtaaatctgtaggatatggaaaaaattatgctataaaccatagaaatagacaagcagttatacctgtgcaaacattcatcgtatgtcccccctagtatgaccctggggaggtatcaaggaaatgttgaataacctgaaagatcttcaagctgaattcaaggatcattacaatttttctgtttccattgtattatgttgaattaaaataggcagaataatttattattcatgttgtcattgattgtatctgatgtctcattataaatctgtaattagaaagaaaccaattcaattatagatgttcgtaaccatcttatgaagtcacttttctcaaatttgccattctgctttgctgtatcgtggttccttaacataaaccttctttttgttaattttatattattagtgacttattttgctataaatgacatatagaatttacataggaggaacaagacatataacaaaatatgcttgatcaattttgttcttaaaatcatacgtaataagagtacacatcgtaggcagaataaaacattatgttagagcaaccacatttcattctgaactttctacaggttttcagaaaatcagatgctctgaagaaaaagcttatgctatggtatttcttgtgattatagcttaattatgttttataagtaccttttgttaataaaatggtttatagggcatttcaaaaatgactataggaaaacagacaaactttagagcttagagtgcttccctgatattacaccaaagaagaattcaaggatattttttggaatggaaatctaatgaatttttaactaaaatatacatgaaatgtacaaaacatctcaattaatttggtcttttgttttaaagcctgataaattctaatagaaaaagatttcaacactactggtttttattgtggcctgcccttttgatcatcttgttaatactcaaagacattggcatcacatggtaaccttggaagataaatgctactctataaatctgtatccttgtttcacaccttgaatgaagcacatatgctatactttgctttctttttttcctgttttagaaaagaatcaatcctagggaaaagtcatgcaagccttaaaattgttaatattctatgaatcaaaaattctgcttctaggaatgtattgttgtaaaataattggacaagtgtgtgaatatatgtgcatgattgcaatgtatattattagaaacatgcttatatattatcatagcatcctttataatgcaaaaatggaaacaattgcccatcaaaagaggattgttaaattaattagggtaacccatacaatgatatataatgcactaattgtaagtaatgatataaatgcatatttagtggtaaggaaagaagttcacagtagaatataatgtacaaaagcagattacaaatgatatctatagaataataccatgctttcatctgtgtgtatgtatttgtgtgtttgtgtgtgtaccatatatatatatatatatatatatatatatatatatatatatatatacatataaattattgaagcaaaatgttaagggtttctgtaaactctatggggatagaacattcttttctttttaaaaattatttatgtatttatttatttttagagggtgtggtttcaccacattggccaggctggccttgaactcctgacctcaagtgatccacccgcctctgcctcccaaagtactgggattacaggcgtgagccaccgcccccagccagggacagaacattttgtatgttttgtttactgctgaatctccagtgcctacaacactgcctggcacataaaacacattcaatagatatttgtagcattaacgagtaaatggctatatctgaatgtggaattgcaaattattttttttgcttcttatttttaaagtgtggcataatgttcattaattacttcctcagtaaaagtccactattttttatgttgtttcattttgagaaaaaatagggttgctgttagccaggcacagtggctcacgcctgtaatcccagcactttgggaggcagaggcgggagaattgcttgagcccaggaattcaagaccagcctgggcaacgtcgcaaaaccccatctctacaaaaactacacaaattagtcaggtgtggtggcatgtacctgtggtcccagacactggggaggctgaaacaggaggttcactcgagccaaggaggttgaggctgccgtgagccatgatcttgctactgcactccagcctgtgtgacagagtgataccttgtctcaaaaaaaaaaaaaaaaaaaaaaaaaaagattgctattaatctttttcagatgtctcaaaagtggtcaaaaatgttttcatagaaacaaattacaagcaaagtaaaaactattccataaaggatatgtcacagaatttttagaaatgtttaccttctgaaggatatattacactcattttacactcctgatattgttgatattttaatttttgcaatgaatatgtctgttggcaattcactggctttttatgtaaaaaatatttgaggtaaaagtatgcatgctcttgatattgttaagtaattcaaatcaatacttcttaacaactcaactttcccataggccttaattttatgtggcatctcagacatagagcatgcatcattactctttaaacatctactgtaattgtgcttttaattttgtagcctttacatagagacccagatctgttgacagagcaaagaaactacaaatcctgtcctttttacttcgtcaccctagctgcttggtaaattaggttcaggtttgcaacagggtaatatcattgccaaagttctttaatcctgatatttaacatgggtggaatgtaaatattttcaatgcacaataacacaaagtttgtctcttttttcctgaagtaatgtccttgtcacagtgttctgttctgaaacagctgtgacatagtgtaaacccttttgcttataaatgtcttttagacttcttcagtgaagggagggatgccagatttgagggcctcaaatttgcttgtaatttccaatacccaacaatattactgagcttggattactaaatataaagtggaattttaaatattagcaaggtctgtctaaaatccttcccaaacccatgtattttgataactgaagagccaaaagctctctaatatctgagggcatgcaactctgcagtaaggcctcaggatgtatgagagtaaaggagtttcagggtatgagccatttaatttaatgctcagatacagactgaggaagcaaactctcagcacattttgaatttagaacttcccagggaagtaaatatgtaaattcctgagttcgctcatgagaaaaaatttcaaaaaatgattcaagatactgccatgaaagaaaaattaatggaggaaagttatgtctgatcactgaagcatggataaagaataaaaccatgcatagattaggtacccaaaaaagagactcataaatgtataaaatccagaggaaattcatgtaggtttagggatagtgttttcctcagagcagtaccatcctttaagcttagaattattaaggtatcatttgcatagagtaaaattcatccttgtgaggcatacggctcaatgagttttgacaaacatattcatttatgtaaccaacacaacattcaagataactgagtatttctaccactccaagaagttccctcatgttcttttgtactcagttccttcctcccatctgcagttccaggcagctactgatccgatttctgtctgtataactttacctccaccaaaattttatagaaaaggaatcatatatcattttgtgttttcacttagtacaatgatgttgagatccacccatgttattgcgtgtatcagctgttcattcctttttattgctgggtatttttcaattgtgtggatatttccattcagcagttgctgagcattattctactgtatgcatgtatccattcaccaattgatggacatctgagtcatttccaatatctggcaattaagaataaagctactataaactttcccatacaagtagatagatgttttcatttctctgggtaaatacccaggaattcccaggatcactggattgtatggtggttgtatgtttaactttatgagaaactaccagactgttttccaataaaagtatttgtactgttttgcattcctaccaataaactgtgggagttctagttgctctacatctaggcaagtctagttggtccacatccttaccagcacttggcattatcagtttttattgtcttttgttttaattttagccattctaatatggccatatggtattttactgtggttgtatattgcatttccccgatgacttatgatgttgagcagcatgcatatgcttatttgttatttacatatcttctttgataaaatgtttattcaaatttttggccatttttaaaaaatcaagttatttgaagtcctttatcagacaagtgtttgaaaatattctctctcagtctgtgccttctctgttcattctcttgtgtctttcaaagagcagacattttaaatttttatgaagtccaatttttattttatgatttgcaatttttatatcctatatagcaaatctttgcttaacccaagaacacaaaaatgtcttctatattttcatctagaagtttcataaagtgtcacatttaggtctatgattcatttagagttaatttttgcatattgtgtaaagaaagaatcgatgttccccgtccttccttccttccttccttcctctctctctctttctttctttcttctctcttttctcttttttctctttctctttattctgtccctccctcccttctttccttctttccttccttccttccttcctattgtcccaataccatttgtccacttgttgagagtactctctttccattgaattacctttgcgcctttgttcaaaatcaatttgccaatatccacacatatatatacagatgtatttctgaactctctattgatctatatgtctaggcttgcaccagtgccacaggccttgctgtcactttattgtaaactgtgaaattaggtagtataaatccttcaactttgttcctcttctacaaagttgtttgtacttttctgattctttgttttttccatacatcatttttatattgtaaaattcaaataattaaataatgtataggctatagagacccatgggttttaaggagcaaagcaaactggcaaatatatctgtatgtataaagtaaaatacatttaatcctattaaacttattgaggggttattgggaagagagaaaactgtaaaagaaagaatacatataaaaaagtaaaggtaacagaatctcggggaccacaattactgtcattagatcccaaatataattgaaataggtttactagtaagttaatctgataacctgcattctattttgttaaatatttcttagaaataagttcctatgcagtttgaggagttggaatttttagatccatagttactgacaatatgagatgtactttccttcctatcttgtcttcttgtttctgttaatgaaagcaaatgtatagtagtctcccgttctgcacagaggataagttccaagacccccagtggatgtctgaaaccatggatagtaccaaaccctatatatactataattttgtctacacatacatacctatgataaagtttaatttataaattaggtacagtaagatgttaacactaataataaaatagaacaattataacaatatgccagcatcactactcttgcacttggaggcagttattaagtaaattaagaattactggaacacaagcactgtgataatactgcagcagtcagtctgataaccaagatagctactaagtgaccaacaggtgaagagtgtatacagtgtgaatattctggacaaaaggatgttttacatccctggtaggacagagtggtgtgtgtagagatttgacacatgactcaggatgccactcagaatggcacatcatttaaaccttatgcattgtttatttctggaattttacatttaatattttcggacctcagttgaccgtggataactgaaaccgtgggaagtgaaaccacagatagcaggggagtaccatatacatttgaaaatacatttgaaatattcaaattattcgcattttttacctatttttctcctgccttcccactgccagccctccagcagtggcaccatctcagacttgcacctaagactcacacttcctttcccacaccaggaccagaggtggtggcggtgacagtggctggtccccgcaccctaccagcttccctgcgccctgcttcctccttctctccccactggaaccatcacccttttaaaatcatttgtgatatacaagcaacagaatactcatttgcttattcattaatctgttgatagaaatatgggttgtttccatatcttggctattgtgactaatgctgcaatgaacatgggagtgcaggttatctcttggagatcctgatttcagttcttttgggtatatacaaagaggtgtgattgatggatcatcgtcagtagttctatttgtgagaaacctccatagtgtttttcatgcaccattttgcattctcaccaacaatatacaagtattccaatttctccacattctgaccaacatttatattttgtttttttctttatttgtttttctaatagccatcccaacaggtgtgaggtgagatcttattgtagttttgatttgcatttccctgatgattagtgatgctaagcactttttcatgtacttggtgctcatgtttatcttctttgaagaaatgtctattccagtcctttgccttcctttagtatttttcaatttataattgacacataataattgtacatatttatgagataaagtgtgatgtttgaaagcatgtatacattgtataatgatgaaatcagggtaattataatatgcatcaccttaaatatctatcattgtactgataacattcaaaatcttctcttctagctaacttgaaatatacattacattgttatttggtatagtcactctactgtgtaatagaacatcagaccctgttcctctcatcttactaactttgtaccgatttaccaacctttcccggttccccactccctgctaccctcctcagcctttaataaccactattttactctctctttttatgaaattaacttatttagattccacatgagtgagatcacgtagtatttgtctttctgtggcttgacttatttcacttaacataatgccctccatattcatccgtgctgctacgaatgacagtatttcatcctattttatggctgaatagtattccaccatatataaataatatatataaattctactatatatactatatatataatatatatattccactatatatattccaccatatatatactatatattccaccaaaaagtatattgaactatatataacataaaagttgaaattttaataaaagaaaatgttttatatacatatatatacacacatacatactatatatacatatattccaccatatatatagtgggatatatctatggtggaatatgtatatatagatatataagtatatagtgggatatatctatggtagaatatgtatatatagatatgtaagtatatagtgggatatatctatggtagaatatgtatatatagatatataagtatatatatagtgtgtttatatattatatatatatataaaaattttcatttattaaaatttcaatttttatgttagacacagagggtacatgtgcaggtttgttacacgggtatactgtacccaggtagtgagcattgtacccaataggtagtttttcaacccatgccctcatccctctcttccccttctagtactccacagcgtctgttgttcccatgtttatgtccatgtggcacacaacattttctttatctgcttatctgtgcatggatacccatgtaggttgtttccatatcttagctattgtgaatactactgaaataaatacgggagtgcagatatctctttgacatactgatttaatgtcctttgaatatttacccagtaatgggattgctgggtcacagggtagtgcaattttaaatttttaaggaacctccacactgcggaggctgtattaatttacattcccaccaatggtgcataagagtttacctttctccacatcctcaccagcatttgttatttctgtctttttcataataaccactgaaactggggttgagtgatatctcattgtggtttcattcacatttccccaatgaatagtgatgttgagcatcttttaatatatctgtttaccatttgtatatatcttctttagataaatgtctattcaggtcttttgtccatttttaattgcattattattattattattattattttgctgttatttgagttatcgtgggtattgaccctttgtcagatgcacagtttgcaaatactttctcccgttctgtaggttatctctttactctattgcttgttttctttgctgcttttgcattttttaaccaggtaatttgagggatttttgctgtttaattgtgggagtttcttatatattttggatattcaccctttgtcagataaataatttgtaaatattttctcccattcttcaggttatctcttcactctgttgattttttttctatacagaagcattttagtttgattttgtctcacttgtctatttttgcttttgttacttatgcttttggtgttatatccaagagatcactgctaagactagtatcaaaagtttttgcccctatgtttttttctaagagttttacaattttaattataccgcaataaagctgttttaaaaaatagaatactcttttgatgcatgcttgatgaaagcattgtcactttgtactatgatctagatcactggtcaccaaaccagtaagcacaggcccaatccacactggacctgtttttataattaaaattttactgggacatgttcatactgatttgtttgtatatagtctttggctaattctcatgccacagtggcagaggtgagtagttaagacgggaccacatggctcacaaagcctagagtagttactatctagcccttttccaaaatggatttttggagaagattcgaggttaaataagggcaaggagattgaagaattattctgggaagaaatgtgtgtgtctgcgtgttgtttaccaagaacagacataaaggttgaaaaagtctgtggggccaagctctagagagctttgaacctaagattaagggacttgaattttattataaagacaatgagcacacactgaaggtttctaagtggtaaattaacataatcaaacatgagattatacaagaaagagctttctgaaatatgaacagagaaataaaagtatgctattatcatagttttgatgagtcatgatagagacagcaagaattttaaagacgttttctagatggaattgacagaatttaatggctgattcgttgtgagggtaagaaaggaggaggcgatgctaattttgacgcttacgactagaaatatcattaattgagactatgggacttttggacatgttgttaagtttgaggtacctgtaagagctctacctgaaactgtccattaggtagctggaactagggatgtggagcacagccaaaatatcagccctcctattaatggtactaactatagtaccactgatgtcttcattttaagcctgcattttgctgtacacattgatgaagggcacagcaatgcatttaatggtaatgacaaaatgagaaatacagtaaaaagtgcagtgctgactcaaaaatggcaacaggttgaccatctgcagggatattaccactggactaaaacaaaaaataaaggcaaacattgccttatatgtaacatttcaattcctaatactgattattgttaattttgtcgttctgttttggaggagatgatctctcgatccttcatgaataacaatgtaaagggagattcttgattatacagaggataggaaagtatttatatttcaaaagcacttcaagttatgattatgtgtcctattttcttctgaggccagatgtcataatttctttcttatattttattagggtatgcacaaagaaagagctggttttgtcttgtcttattttttcaagtagtaggtattcaaaaaattcttgttaaatgaattaatgaaacattttagttgttccatagccaacaagtgcgctgtatagtcaatatcataccagttattttcaaaaatacacaagcagaatgatccagcaacttaagaaccatactgggaaaaggcaagtcatacacacatatgctatttggaaaatagtatacaagcaatataaaattaaaatatataatgcatacagtaagtactataggatcttagagaagagagagatgaagttgggctataaagttttgggaatgctttattacggaggtgggatttcagttgttaaaatatgtggagacaaagatgtgggaaggaaaaaatatgtaaactctatgtcatggagtaaaggcttagatacaacagatacaggaatgagcctatttagcatcttgaatactgaggaacaatatagatccgtggttttgtcatactaccttgactgactcagaagttacatataggagcaggatgcgtatgtagtagaggtggttatggttagacagaataaggaagtagtttatgcagtcctcggaaatatatctgagcattctaaattttaatatagagcattgaaatgagagcagaatttgaggagcggtttaagaaatactcctgactttgtggtaccttagactggttagtgtattaaagcatcaaataggaccaatactgtattttttataaagaagaaaatggtacaaatatgttacagtcaaattaaaataaattaggcttggaaaatggcttagaaaatgggacacacacacgcacacaaatcctattcacatgtactaaggattgacatgggtacatatttatcatggaatgttttggtgctaaattatttaaagtgcctgggatggagtagtcacagtagttgttggatcctactctcctcactctctgtccctgtgctctattcctgattcactcagaactactgttgtccccagtaataaattataattttaaaatttatccagtggtttgattaaagagatatgtttctataatcagcttactaacactgtctgtaactgacactaagaatctctgtattgtttttcttataaatacaatggattctccttggctgatagttctgcgaggaccctttattctagtggattttagcatctggtataaattgagtgtcaaaagtgcaaaggatttttaagctccatataatgttattgttaaagttttaatttgcatcaatttaattctcttgtcagttgtcactccctattaaagtcgtgccccatcacatgctgattaagcaaattaagtctgaggtacaagatgatgtggcttcttgggaaaggctatccataggtccagattccagctattttgagctcatcggtcattaatttttatatcttctaggaatgcagaatagcactctctgaacatcaaagctttgtaaatggtgtcagcattttacagctctcttgagaaaccatgaaagccactgtttaatgatagaagatttctttttctctccttggttattgttattgttcttgtggtgtcagtttacagtatattcatttgcattaacctttccaccttcacagaataattctttaagacctaagtcagatcatggcattcctcaaatccatccaatgacttgccacttgtctcagtaaggatacttaaaatgacctacaaggccccacatgatttagcctctcacttccattctgactccatcatctatttctctcatcttccctcatactaatatagttacactgggctcaatatcctttgaaaatggccaggcatccttctgtctctgagcctttgcgcttgccctgtccacctccctgaattgttttactcctagctattcacgcgacttacacacactgcctcacttccttccatcctttactcaagcatcatcttctcattgacagttgctctgaacacatatctaaaattgcatcttccaatccttgacacttcctgcctctctttcttgctttatttttcttctaatctttgatcactgtcttacaggctatatattttaccaatgtatccttatattttccgcctctcttcaattagaatacaaactccatgagagaagagacttttgtctatcttgttcacttctaaatacataatctccataacagtgcctgatacaaagtgggatctcaataaatatttgctaaatgaacgaatgaattttaatttactctgtctgtacacattttagtatatacaactctttcttccctctttccatcttccctcccttctctctttctttctttccaagtggggctgtagaacaaataggtcctcaggtccctctgagttttgtcaaggttatcagtttcccacagactctcagagataacccaaatgaaatgacaactgtgttgattaagccagagggaattccctaccctggtcttgtagatgtctggctttagaaggacggatgctatggattttcttaagtaaaggcattgtcagtttttttggagtgtgtatgaggtcaatccactacttgtgtacaaagggtagggtctcatgacctgtccatttattcatcattgtatctcccatgctttgcacaaagcctgaaagttaccaagtatttttaaagtatttgatgaaagaaagctaagatcattcagtcttcctattctgacagacctatcaatcttctatgcaagagtaccttcctcacctgaaacaaacagaatgggagtggttggcagccatgttgaaattccatccttgctatttactttgagcaagtagtcaaggagtacaactaactccctatgacagtgtaaaatgccccccccccaacttttttttttttttttttagacggagtctccctctattgcctaggctgagtgtagtggtgtgatctcagctcactgcaatctccacctcctgagttcaagtgattctcctgcctcagcctcctgagtagctgggattaccacacccggctaacttttgtatttttagtagagacggggtttcaccgtgttgtccaggctggtctcgaactcctgaccccaagtgatccacccgccttggcctcccaaagtgctgggattacaggtgtgagccaccgtgcctggccacaacggcccctctctgtggagacctaccaaaggtaaggaagtaaaacaagccatctttgaaattttaacaattctttgaatgtcaaatatgataaccccagacaggatgtggaatgtaataaggtctataacaatgagaactaattagatatgccagaccatgtaactttatttcaaaagccagaaacttttaatgggcctttttatttcccttgtgtgtggcctccttccttccaacacaggttgttgtccaaaactctctagtcattcttaattacctgtttgcctcaggcaagaggttctgactgtcactccgaaagcagccttgggcaaaataattcacagctatatttaccaaaaattatttcaccagtgcatttcttcacttctcataatcatacttgccttgatgcttttaagattgttcattgcttggagttgtttgattctatccatacctctgtattttgagattttgacttgttagactctctgggtcccatgggtctgcatctattcttagctaacctaggaaatcaatactccaatatttttcaagatcacggaattaaaaatgtatgagcctgaattaggggaacatctcatctaaccttcagctttttgaaacttatttaatgactgcatacatactatatcctgatttgttccaaaaggaattttaagcatctgaaaaaatgaatacagtatgaaaacataatatattgaaaataagtgatggacatttgagaagatagactagaaagtgaatatttgcctcacatccttctttatttctttatgaaataagagaataaatttatcaaaaaggaataaatctataacggggaagaaaatgggagaggatatcaccaacaaatgagattttttttaagtttccatgaaaataacctaatcgaatagagttcagaggacacttacaaaagggcacctaaaaggagataagaataatcagaatatccttaagatctgttggcaacattgcatgtatactagaacgtgatgaagcagtgcctttaaaatcataacatatgtttccatactgagaaaaattacaaatcaaatgtgaggacggaattaaaaacacgcaagagttcataaatgtttccacccacacgccttttcttagaaagttgtttcaggatgtgcttttccaaaaaagaaaaaaaagaaaaagaaaaaaggtaagccaaggaggaagaatacatgggaactgggaaactgtggatccaactcaagagagtgctggagcaatgtttggatctaacagagactctagaaggaaatgttccgggtagtgggatgagggataggagaaactgatagaatagaatgtatgattgagtactttggggaaaaaaggaaagggctgataaaagaaaaccatttaaaaaagaaacattatttaaaactccagcaaaaaaaaacagaaaatctgtttagaaagtcacggtctaactatgaaaccaactaaattgtaatataatattcagcagttaaaaagtataagacgatagtacctacttacactggatgctataatagaaccattccccttcatgtggctcaaggatcacagccttgagctcaaggtgaaggaaatacagtcccaaggtagaacttgacctgcacggaaagtgttgacattgtcctaataatgaaattgctatttattgattttgaggttttataatcatcctatcaaaaatacttgaaatgttgatattgattgagaacagaatttaaatgtaaactatttgataaaataaatgtatgtaattcaaattagctaaggctaggacatgagtggagggtggttggaaacatggaagaaatggtccgtgtgctaatagcctcaaagtacagagggagtcaagagacactgatggaagttagcagaacaaggaatttaatgtattgtttaaggtaacatatgtaattaatagaagaaataagtctaatatgtatatcaaagattcagaggagaaaagaaaaaggatacaattagtaaacttaaatctacatctttcctagatgagaaaatagaagtatatgtatattatttagaaatgtggaggttaccatcataaattctgtgaggagaaacactcaaaataagttgttttagggaaatggtacttgatggagggttaaggagaggaaatctattgctatcacggtttttcggtttctattgtttgttactatgtgtatcattttgatttaaaaaataaattgagtgcttctggcattatggaaaagtaagtgctgttgagactgcagagtagttacaattgggatagaacacacactactgggtttaaagggggtaggcaagtatccccagaagccctataatcccaaaacaggttttgggtataagctaggaatatggagtggaagaaagctgggaaagggagacttcctgagtatgaatgactatagtagcaatgtctgtgttggtatgaacaagctttgatctagagccgagaatggagaaactgaatgtgggactctgaactaaaccgggactttaagggaagtaaaaatggatcctaggaagtgggcattggccattagcagaagcagaagcaaagcctttatgaggtaatcttccttcatttagacagcactctcatacatttgcatcaagcaatgacttcacaatcaaacagcacacacacacaaaaaacagcaatgagaaaaaatcagcagaaaaaaccagaacacattatgactcccataactattgatatagagattgtaacgcatgtaatataaaactgttgtgtttgaaatgattttttaaaagaaagcaattgcaaacaataagaggccattagtaatagactagaaattttggtaagtttagaagttgtagaaattaaaatgtaactagtagaatagaaatgtgataatattttcataaaatagggtactatttagttatgaaaatgaatgaactacagctagttcaccaagttgccttcttgcattctttctattcattccttttgggattctcaccaggatgtgaaattttcagaagtgatggaaaatgtgaacagatatagaaaacacaatgaattccaagcatgataaaccaaaaaatactaatgcaaaggctcattgtagagaacctacagaacatcaaagacaaagatatattaaaagtaataaaataggaaagattgcctgcaaaggaaagacaattagatagatagcagactactaaacagcaaaatcaaaatgagaaaaatgtttagagaaaatataacaacttagaatgttatactcagaaaactatttctctataaagcaaaataaaggtatttgaatatcatcataaactgtgaaactttaacccccagtgacttacactcaaagaaacctctagaggatggtgaaagagaaggaaaacgtttttaagcacaacaaatagaaataaaaaagtaagatacggtaatggaaacaaatcctaatacatagtaagtgattataaatggactaaacttaccaattaaaaacagtagttactatattggataaaaatggaaaaattacaaccatcactaggtctttttgaaagatgcacctaaagcatgagcacagaagtaaaaaaactgaagtatgagataaaaatatgctgggtaaatactgactaaaaggaaaagaatattgttatataaatatctgacccaacagactttaagacaacaaaaaagcctattaaaatgaagagggtcactacatgaagttgaaaaagttcaactcatcaggaagataacataattctaaacttgcatgaacataacaaatatgtcaaaattgataaggcaaaaggttgacacaattatatggggaaattgatacattcactgttgcatacttagtggaaaattttaacacacctttcttaataggtcaagagtaaagaaaaatcaatataaagaaacaaaaacaagaaaactggaaacaacccaaatatccattttatagtaaagtagagaaaaaaaaagatatctttataaaacagaataccatacagcaatgacagctgtgaaaataaatgagctatcgctatatcaacagtatatgtaaatctcacagacataacgatgagaaaaacaagcacgaaagagtctatactgtatgatttctttatataaagtgcaaagactataatataagaagtcagtttttaaacttaacaatcagatctttgtcagtctgcaatggggacaggagagctttcccttccaaaaatcaagacttattataaagctgttacaactaagacaatgtggtagtaaaatgtgttaaaacaaattgaccatacatgtattgaaacattacattgtaccccataaatatatacaatgactatttgtcaattaaacataaaacttttaaaaaccaaattggccaacaaattaggataaagacccaagaaatgtgaatgcatatatagaactttgttatatgacagaggtgtccttgcttataactaggcaatagaaggactctttagcaaatggtactgggagaaaatggttgtccatgtggaaaatgtaaagcaattggatagttacttaaattgcaacattcataaaaactaattgcagaagcattgaagactctaatgtgaaatgcaaaacgttaaacattttcgaaaatataggataacctttatgaccttcgtgcagggacagttttttaagacagaaaaaagatctgagtataagatcttggactgctctgtagttaagtatcgctattcatcaaaaaacaaactagaaaaagagggaaaatgaagccactaactgggagaagctatttgtaaagcaaataacaaaggattagtgaccagaacaagtcagaaatataactgaataagataaacatgaacaacccaataggaaagtggggtaaatacataaaacaggcacttcacagacaatgaaatatctataggcgataaacaatgaaaagattcacaaatcttttactaatgcaaatacaaaataagaataaaataatatagcaccacgcacccaccagaatggcaacaaattaagaaggtagacagaggaagtgtatcaacgggagcgtaaattagaaccggggaaaagaaattgtcattgtctctcaaagcagagcattcacatactctatgaccaaacagtgtcagagaaattcttgtatgtttttatcagaagatctaaatagtaattttcataggccatttgtatgtttcataggctatttgtaacagtctcaaactagtaacaatccaatccaaatgtttagctattggagaacagagaaatatatataacatatatatatatgtgtatatgtttatatatgtatgtttatatatgtttatatatatgtttatatatatatataaaacataacatacctctatcttcaaatgtatatatttttcacataatggaatattatctagtagtgaaaaagaagtgagcataactacacacagaaacatggattaatcttagaaacataatgttgggtaaacaaaaataccaagtctccacagacatatatggtatgatagaaaacaacttttaaaaaagaaaaactgagaaatgtgttgtttagacttatataaatgtgtgataaaactatttcaaaaaaacaagggaatgataaaattcaggatagtagttttagggaggtgggtttgtggaaaaacacataggtagaagcaaggtatgggcaacgacctattatttggatgttaactatattgttatgctttatgatttgcatatatgttgcatttcatatatcattttatattaacattaccaagagaaaatgaaaaagcacaattccaagaaacagtggcagaaaacaaagcaagaggaaaccgaagagttgcaatatcaaatagagccagggatgagattagaatctcaaattacaggaagtcctataagttgctaggagaagaacacaaatttggacataagcttcttagcaactgaggaaacgagaataattgattacatgggtcatgagattcataaaaccaaattttaaaagagaaacaactattcctgctacagcacatctattgttgactttggaactaaagagctacttcaatccaaaaactaaactatataaagctataaaaataaacatatccctaagatcccaactcctagcacatatttctctaatttctctgactagtcacgcagtcagtctttaggcagctccaggctgcagagcctcagaaggaagaatgtggtggggctttggagaaaacagatcctgcctttcctggctgcactctcaagtccctcctctcctctcagttaatattccggaaatctcgtgcgcctgtgaaatggcttagccaagtccatggtaatagaattggtatgcaactcccctggatttgtcgactgtcccagatagcaggaagaagacatggagatgtgagggtggtgattgcttttgttttatctgtctgttttcagaaagtgtcaccaaaggcaaaatgtgacttggtataataagaattctttttcatgcagttggtcgttgaaacaattatttctagaggaactctttatggatagtttgaatatcacttcatagtatataatatataatgtgcatgtatttaatgctaatcagttgctatttagtgctggcctttacttttgtgagaaatatagaagtatgagatttgggaaaaattacaggccaacccgcttcacacacacaaacatacggacacacaaaactatatattgtgtaaagtgaaaatccccttgcatagtatccataaccctttacaccctagtcccaacccatttctctaacatctcatgccatcctcttgagtgttttctaagctttcccatacctgaatttttactctcccagtaaaatttcactcctttcttgctggggcagcctctccacttctgacctgatattgccctattacccccatctggcacattcctgtctccttcaaaactcagttccaattttggcttccccattctctccagaccaaggccaatgttattttttttctattatggtcccaatagcttcttacatacttctatttcttttctgtctctcttcctatgtctgaagttggttcttcacttcagtcttagactcaatgagatgatgggcagacatttgtgtggctacatgaatcatctctaacaatggattgttatttattaatactgatcactatatctgtttattgctttacatttttttcaaagtgttttgatttccattagccattttagtgtcacactatttctgggaggagatattattactgcagttttgcaaatgaatcaggtatgtatatatgagttgtctgagaatgaaaatagtaatttgacaatatctagcaaaaataaatatgcacttaccctttgaccagcaacctcacttctagaaatcagtctcaaggcaggcatcacaaaaataagaaatgatccaagtaaacagctattaattacaatagcttaattaaaaagacactagaaataatgtaactgtttatcaagagggaactggctgagtaaactataggacatccacccataggagtgttatgcagctgtaaaaagcaaacaggaagatctatatcctgtggagtggtagctccaggacatactgtcaaatgcaggatgcagaacaatctatgtgatatatttcatttgtacatgtgtgctatttttaactttaaaaagaagcaaaagataaactaataaaaatggttacttataggaaagaagggaagtacagcttggaagaaaatagaatctatatttctctgaaactaactttttctatagttttgactcggtaagtgtgtaaatgatttaaatgattctgaaacaaaagattttaaaggtaaattcttaaaaatgtataacatactgaaaaatgttttacatatcaaattggtagataaacacacaagaaagaattattttaagtgactttaaaacagagtatttttgcactactttcttagtagcatatattcagaggacaaaaataaaacagaaataaatcttaaactgcaatcagaaatctcattgttagaatattacagtattattttgaatctatatggagagagaagagagagggaaagcaaaaaatgatatcaatatcattaggaacttaaattttgataagacaaaagagattacactgtatgatacaattttgtatttaacatgtgatctcgcatgtgaaattgaaatatcactatgtactcaggatttagttttctttttctaaaaattacaattttctcacctcaactttctgaataaaagcattgaagtaacgcttacccctagctaccaaattgtcatcttaaataccaatccctattaaatgaacctgaattcctaggagaaatgggatatttcaggtctgagacagggtatgtacaagatgagcttggggtatctagtgccagaagcaatatctactgggtcctgttaaagcaacacagaagccaaccttagggaaatcctgctgtcaaagttagaacaatttgagcattataggactaatgagcgcaatggacacatgaaatatataaacagaagataattcataatgctaaaaaatagtctactttggagtttactaaggaatcaactcattattctaaaaattggtaaataaagtatgataatgcaacatttaacctgccagttgtgtttgaattgtatttcagggtaaatgaacagcttctaagaaaacattatttttagaactcaaactaataaactcaggaccagaaaattataattgtgtaaactctcagaaaatgctagattgggtccaggcaaaaattatctaagggtgctacaatttttaagtgaaaagtaggtgggcaaatttaagatagatggatcaggcttaaaacacttgaacccactgatcaatcttagcattactacaagtagaggagccagtcttcatgtacctcccgatgggatgcaataggcagttatatgctgctcttgaaatacacttgcaaaaagagaggggagctaaatttaatgatgcctttacagctaacatctaatttcaggaaatacaaagaatgggggaacctattaaattataccaggatgatacaattggccaaatccataacttagttaaatctacagagaagcatggtctgctttctttagcaaattcatttcataggaggaaaaaaaaaaaaggaatagcggaactgttataaagtaaaagagacttatgagacttaaaaaccaaatgcaatgtgtgaaccatgctgacatcttgatttaaacaactcaactgtaaaaagacagtttggagacaattatgagaatttgaatatggaacatgtattagaagatatttagaaattattgttaattttacttgggtcgtgatggtattgtggttgtactaaaaacattcttctgtaaggtcgaataatatcccattttgtgtatataacatattttctttatctattcatccatcctggggcaattaggttgcttccatatcttggctattgtgaataatgctgtaataaacatgggaatgcagatatttagatgaggtggtgattttatttcctttgggtatatatccgcaagagggattggtgggtcatgcggtagtactatttttaatttttgaagaacctccttactattttccataatggttgtaccaatctacattcccactaacagtgtacaagggtttccttttcatcaccccctcaccagcacttgttatctttagtttggataatagcttttctaacaggtgtgaggtggtagatatctcactgtggttttcacttgcatttcccttacaatgagttatatcaagcatctttttacacacctgttgaccatttctgtctttgggtaaaggtacatgcatgtcatttacccatttttaaaatcagattatttaaaggctttttgctatcaagttatgtgagtttcttacatgttttggatattaacctcatcagatctaaaatctgcaagtattttttcccatttcttggttgccttttcattttgttgattgatgtctttgctatgcagaagctttttagtttgatggagtcttatttgtctattttttttttcattttgttgcctgtgcttttagtgtcatatccaagaaatcgttagaagagtagtgtgaaaagctattttcctatgttttcttctaggggttttatggtttcaggctttatgtttaaatctttaattcatattgagttgatttttgtgcatggtgtaaaataagagtccaatttcactgttttgcatgtgaatatccagttttcccaacactaattattaaaaagactatcctttccccattgtgtactcttagcaattcagagtcttttgtggttccatatgaattttaggattatttttctctttctgtaaaaaatgccattgggattattattattattttttttttttagggatggggtctcactctgtttcctagacgggagtgcagtggtgctatcatagctcactgcagccttgaactcctgtgcttcagcaatcctcccacctcaccatcctgagtagttgggtttacaggcatgcattaccacacctagctaattaaaaaaaaaatttagagagatggggtctccccatgttgtccaggctggtctcaaactcctggcctcaagcaatcctcccactttggcctcccaaagctgtgaggttataggtgtgagccactatgccctgctaccattgggattttgatagggatggcactgaatatatagatcaatcactttgggcagtatgaacatttaagccatcctaattcttccaatccattaacatggggtcctataatttatttatgtgtcctttaatttctttcgccaatgttttgtagttttcagtgtttaagcttttcacctccttggtttagatgattcccaggtgttttattctttttgatgctgttgtaaatcggagtacttccttaattttcctttagaatagttcattattagcatacagaaacacaactgatttttgtatactgattttgtatcttgcaactttactaaatttgtttgttctaacagggtcttttggtggagttttcagagagatctatatataaggtaatattatcttcaagcagagataatttcgcttctgtctttcagatttaaatggcctttatttctttttctgcactctcatgttcattgcagcattatttacaatagccaagatatggaatccactaaatacccattattagatgaatggataaagaaaatgtagtatacacatacacaatggaatattattcagcctttaaaacaaaagaaatcctgctacttgcaacagcatggatgaactggtaggacattatgctatgtgaaatatgccatacacaaacagacaaatacttcattatcctgcttatataaggcatcttgaatagtcgaactcatagcagcagagtagaaaggtggttgccagagggaggggaagggggaaattaggaaatattgaacaaagatgacaaagtctcagttatataagatgaataaattttggagatctactctatagcgtagtgcctgtagtaagtgatattgtagtgtatacttagaattttgctaagagaggagatcttcattgttcttaccatctacacatacatacatacgtacatgcatacacacataaatgaaagaatgaatggataaataaatgtagcagaggaagcttttagaggtgatggatatatttatggccttgattgtggtaatggttccagcggtgtgtacttatctccaaactcatcaagttgtacacatttaaaatgtacaactgtttgtatctcaatcagaccttaataaagtggtttactaaatgacgagaacacatggacacatagaagggaacaacacccactgaggcctattgaaaaggtggagggtggaaggagggagaggattaggaaaaataactaatggacttaatacttgggtgataaaataatctgtacaacaaatctccacgacacacatttacctatgtaacaaacccacacatgtacccctgaacttaaaataaaagttaaaaaaataaagtggtttaaaaaacactccagataggggaaataaattctagtgttttataccactgtagggatgactatagttaacagtaatatatagtttaaaatagctggaagaaggatattaaatgttcccaatacaaagaaataataaatgcttgagatgatggctatgctaattaccctgatctgatcactatacattatatgtatggaaacatcattatgtaccccataaatgtgtataattagtataaataaattaaaaattaaaaagaaaacattcttactaaaattgatacactttacataaattatatttcaataattaaatcctgatttttaaaaggattgttagagatgcatacttctgatgtgttcgatctgcttcacaatatttaagtacaagggaaaatagcatctatcgatgagataggattggtaaattgttgataaatattgaagctggatgattgatacatggaaatcgatatggttattatgcttttgtatgtttgaaaattgtcatgataaaaattagtagaaaaataaatgaaagcaggcacatcctattagtagaatgccagcccagagcgtctgagcctaatgctctttatagtaactttaagaacttgaccgaatataggcgctatggctcacgcctgtaatcacagcactttgggaggccgaggtgggtggaccacctgaggtcaggagttcgagatcagcctgaccaacatggtgaagccccatttctactaaaaatgcaaaaattagctgggcgtggtggcggaagcctgtaatcccagctactccggtgcctgaggcaggagaatcacttgaacccgggaggcagaggttgcagtgagctgagaccgtaccattgcactccagcctgggcaatagagcgagactccgtctcaaaaaaaaaaaaaaaaaaagaaaagaaaagaaaagaacttgacctaggccaggcatggtggctcattcctgtaatcccagcactttgggaggccaaggtgggtggatcacgtgaggtaaagagttcgagaccagccttaccaacatggtgaaaccccatctctactaaaaatacaaaaaaatagccaggcgtgatggtgcgtgcctataatctcagctacttgggaggctgaggcaggagaatcacgaacctgggaggcagaagttgcagtgagctgagattgcgccattgcactccagcccgggcaacaagagtgaaactccatctcacacacacaaaaaaagaacttgacctaacagcagacaagtgtattaaatatataatacagcatcccggttcctagtacccgacaaagaacttgggaagataagactcattctcaaacaactctaatgcaaggcaccattccaggagcccagagatttagatccattctaagtataggttctctggttatctgtatatgcctaggaactctgggactccagtccacgaaggaaggacatttcccctcttgctacgacagacagtttgagtgagtataaaaataggcccatgctttcaaatctgaaaacagtctgcccaagaggtacctgaagtctacgttagacccattgcagtccccacattcattgtgctgcagatttgagaggaaaagcatttcctttgcctttctttgctgacagctgaactgcttgtgttagtcagccccttcctctatagagacaaacataagttttatttttatgacataagggatccattgttttgtcaataatctgaggggctggggctgagtgcgaatagaggtgacagtattccaatgtatgtcttgcaactgttgttttgggttggatttttggtgaagctggtagtgacaaggtggtgtgtgtgtgtgtgtgtgttctgctattccacacacaaaatattaagtaaatgatgtgtttttaccatctctgggaggaataggagcagtagtggtgccaatggtgagagtaccagtagtggcattggaaaggggaaggtagagaactttgaggtgcttcagaattagctggccttaggcagtggggacaacagaaggctgggctactttgattagctgtggtagagacttgtcctcaaggaaccaaaccaaatagttgatctgctaagacagtagtagagataaaaataaattaccaactgagaaaaaaaagtgtaactgaactctgactaaggattggagatagatggggatagagacagtcaaaatgtatcactcttagtagcggcatatggaaactggtggaaggacagcagaaagaggttggaagagctcaatcccctgtccataaaggacttctggattggggtatgggagctaagctctaagaagcagttatcacccctggagcaggaacctgtttgtttacatattaaattgacagaagaaggatagtctttcaattgtcatatctccaagattttcttttattgcaatgatatattttatgtattttaagtattagactggcttataaacttatagacttgagtatcagagaagtttaaggcaacaagaaatcatttggggaagaacagaaaagattcatggttcaaaaataattagaattgaatcttgaagtataacatagtggtatgatatagctggaaccaagagaatagatacagtctatgaaacagtatagaaagagaactgtgtaaaggtagaaggctggattttgaggagtgtctatcataagagggtgaggagggaaaagagagtgagaaagaaagaatggaataggtaggcatcatatagtatcatggaagctaaaaattagaaagatgcactaatggttgataaatgatgcctaatatcatgaaaaggtcaagagcagtggaggatggagaacagctcagcttgatggctagccagactttgaccttggaggtgcatacacccatttctgctatttgatctgtttttgttctactgttttggaacctcgggcaatgtataattgtcactgggagatctacagtaaccaaacctagagtacttgcaaatggaaaggattggatgattagctgggttaccttctcaggtccagggataaaaccttgagccgaaagaagtgtgaggcaccctcagagagcactggggaccattggagaaaaggggctcctggcacaagaattaaacaactcctgacaacatatatgcattttctttgcatctctgcgaagtcatggaggcactttagtcttaatccaccaaaatatgcctttcaaaatgattaggtaattttgtgccataatgtactcccaggtaaaattccctggttgaagaaaatgtcctccctctgaagttatccttttcctagcctgcctgcaatgcaaggactgcacagagccaggctgtatataaagctttaaagaaatacactgttaacaacagaatgcttctgtgtgacagagtgagggagggatacaaactaaaagggtagctggagaacgtgccagatctctggagtttttccatgatgcaatcatcctcagcctgtaatcaccctcgctgacaccctcaccccactgtttctcctcactcacgccacttttcgtcagcaccttcctatttagcagagatccccatttctggtactttgcgggggctaattatcttccatttatctgtgcagccctgcatttgccatctattagtccagaaacataaatgatgtaaatccttttatatctggctgcaccacctaattattcgtcatttgtttttattctctctcaatttagcatcatctgcaaagttggaaatcatgttttcatatcataattagggctctaagaaccgcagagaaactggcaaatacacatgcctttgcttttcattttaattgtgaatttaaaagtgagaaaataaagtagggctgaatgatataatagagtaaaatgaaagtttctggaatatagatgaggaaacgtgatagagcaacatgggctgagaaacttccagcattagagtgcaaaagccaacccccaaagtgaagccgtcaagtagatcagcattcttgcctgttttctttgctgatgagcatcatctttagatatttcattccgtactttggattatgcctagagatgcacaattttgctaattgaatgaacacctctccttaagtatacaaaagttttacttttttctaagacagcaatctggttaaaattgaacagtatgtaaattgagaagacatgaccactactgagtggaacagaaagaatccttagatctgaaggggtgggggagggagggatgggaatgacctggtgagtaagttcctgacattcttactgttgttatgtctatgtgcttccacaaaataacacctccttggaggagcctctcccatgattcacttagcttttcttctccagaagtttcttcaaagttcatttacagaactttctaaagtaacttcacctgagtctaggtcatctagaggtttttcttccctgatacatgtttccttcttatccttcctctttcaacagttccatctatatttctgtactaggtgggatttgaatttgtatgtatcatttatataagcacagatatgtgtatttgtcctacctactatagtagttaaaaatttcaagggcaaggttaatgtattggtcataaaaaaataggttatggttttgtaacaagacaactcccaaatagcagcagcttaatagaacaatgtttatttctcactcacatttcatgtctattgcagatcagcactggggctctgctcatgttttctcactgatccaggctgataattccagatacttgcttccgtaatcctagaaggaggcataaaagaaactggagaattatgtcctgactcttaaagttctgtcgctaagtgatacatgtcacttctgctcatattttactggtcaaaggaacttatccggtcatgcccgagttcaacagatagttgatggtataggtagggtctctgaatagctgtgaacaataatacagtatattccaaatggtactttccatctttatctctttttgtagaactagtaagagtagttctctaaacacagtgaccaccagggtgtcaaaatatacagctaatcagccaaagaaataatttcggtatttttctataagacattactacctctttaaccagaaatctgcctgccgattctttgagcccacgaacgttactctgtgatattcttctgaactatgtttccgttctatacaactagcagtaggcacacagaagcaaagtgagaagtttatatgtacatttgaccaaaagaaaggatgattcagtaaagtttgaacttattctctccctttttaaaagaagtaagcataggacaccaaaagtacaggcaacaaaagcaaaaataaacaagtgggactacatcaaactaaaaagtttctgcacagcaaaggaaacaatcaataacacaaacaaacaaaaaaacagtgtacagactgggagaaaaatatttgagaaccatgtatctgacaagatgttaatattcaaaatatataagaaactcatagaattcaacaacaaaaaacaaaaacaaaaccagataatccaatttaaaaatgggcaaatgacctgaataaatatttatccaataaaaataaataaataacaaaaaacgaagaagacataaaaatggccaacaggtatatgaaaagctgctcaacatggctaatcaggtgctcaacatttgctaattgcaaatcaaaaccacagtgaaatatcacctcacatccatttggatggcatttatcccaaggacaaaagataaccattgtggtcgaaggtatggagaaaagggaacccttgtccactgttaatgggaatgtagattggtacagccattgtggaaaacagtactggaggttcctaaagaaattgaaaatagaactaccacataacccagtaatccctctcctgtgtttgtacccaaaggaaacgaaatcaccatcctataaaaatatgcattcctatgtttattgcagcattattcacaatagccaagatatggaagcaacttaagtgtccatccacgaatgaatggataaaggatttgtggcatagaatactatttagcttaaaaatggaggtcctaccatttttgacagcatggatgaacctaggggacattatgctacatgaagtaagccagacacaaaagtaaaaatactgcatgatgtcatgattctgaaaaaaaaaaaaaaaatcaaatacatagaaacggagagtaggacaatgattaccagatgcagggatgagggtggcggtgggatggaaaaaatggagaaatgtgggtcaaggggtacaaagttatcgttatggaggatgaataagtctaaaagtctatcgttaataatattgtattgtatacagaaaatttgctaagatagcagatttcaggtacttttaccacaaaaagaaaaagaaaggtacctatgtgagatgatggatatattaatttccttgactgtagaaacctcttcactattatatgtacttcagtacatcatggtgtataccttaaatgtatacaattaaagaaagaagtaaaataatttcaaccaattgggaccattacagagatcggcctttgaactttaatatagtaactatctctattctatttttaaaaacctcaaaatatttaaattttcttgtctgcagctccatatccctgaatgctttgtgccttgctctagcaggcctagatattgaattcagcagcctagccaacaccctaccagagctgctgccatcacgaattattttcaaaaaaggagagcttgttacgggagggaaaagggacagtaattagaatttactagactatgttaaagtcacaaaccaagtagagtactgaagagggagcaacatgagcaagcgtgacctcttttatttttattggaaatagctttaattagaagtaccaacaacgggagatggagagatcacaaagaaaagaatcaaatgtcctacaattatagtttggcttgttttagtgttagctttccattctttgacagtgctcccttaaccctctaatcatcatgaactcaatctcataatccattcacttttgcttgaaacatttaaaagccctggcatgagaacatagaaatcttatttcggaaatgttgaagctattcaaaatattgagccctcaagcaaaaatgtcagaaaagtcttcttgtttacccctggttttctacagagtttccatctctatccttgtctcagcccctccgcctcggggtccctggagggggcttgaaaacatggactgcttctgagagtccaggttctgccttcctaaccaagtgcacctgcaaggcttgcgtcagccagtgcaggctctgggcaccacggggacccacgtgtcagaactgacatctcctgcagcttctgcagccttggctttcagctgcccgtgatcacaaacaacagtactggccattggaggttagcaccgctgagctggctgctgcttcctgttttttttggaggaaaggcataaaaattgcagcttggtttggaagtccttgccattaggtaaaaagcagatggatgttttctggagaggtgccagagcattcatgcttgaaaccaagaaacacacacacacacacacacacacacacactttttttttttttttcactattcccagcctcaatatttggattgaatcatgttttagccattttgcttacttactggggtgtatgtgaggtcatttaacactggaaaataaggattaaacttttcaaaaatattttatttagaaagaactcagtagtgatgttttagaaagttaatctaatttccaaaaatcgtcaaacacctgaccatataaaatcacaaaactcaaattgaaagaaacccgggcagtcatgtggtccaatctgtccattttacatatagaaaaacaaagcccaggaggtggaatgacttgccaaaggtcacccagattgggagtagcagtcagtagaggaactcagaactcctgagttatctttactctttctatgaggcgacactagacaatctacaaatatctgtttattttggaaaatatcctttgattttctgagaagcaatttttattttagactaatattaggaattttggaaacagaagagctcataaagaccattcggccaaccccagtgtgtattcttcaagttcctagcagcttgggattgaacaagaagcatgttgatttgaaggagagttgatctgtcattaagaaaaacatgtcatagatacttttacagctttattgagatatatttcatataccatatgattcacccatttaaagtagataattaagtgttttttttagcgtatttggagttgtgcaatcattgccacaagctaattttaaaacattttcatcacccccaaaagaaacccttgtacccattagcactcactccccatttgctattcctccagcccctggcaatcactaatctactttctgtctctatgcatttgcctattctgtcacagataaatgaatgacgtgtgtgtgtgtgtgtgtgtgtgtgtgtacaaaaacacttccttgtaagttttgagctaggactgctcattacaaaagcagtatatatgcattttagaaaatttgagaacacaaaaaataagaaaacaaaggcattttatttctacaacttcgattatgtcactattagccttttattacatattcttctagaatagcttctatctatatctatagctcctattttaccaaaattagatcacactggatatgttgtttgccatcttgctttttttcacttaatactctataatgtcagtaagttgctcttcaattatcaggttagaccttgagaccaacacctctatggaagggaagtacccagataaagagcacttttgggaaaatagaaatcagacatcaagactgggattgaatttatgaaataccttaaaaatattttcatgtttgcctccataaaataattagcttattaatgataatatacagctgatcccatctttgggagattatgattctggcaagatatcacattttcgtcaggctgaggagatgggcagccagatatctaatgctgtttgatcccaaataccgcgtcctattatccctaaacttatgttctttctcaataaaagggttctattttactaggttgtctcttggtgatttacgggagtccttggtttatctcacggtgtttcttttgagaatcaaagaaattccgagacattaacagaaaaacgtcagctatctccaacaacatactaataggagtgatatccatttcgaagaaatgctaataaaaaattacaactcaaaaatttagtgaggttatcatttaacccacaaaagcattaaccatttgattccataaaagtagtttactttatattttaaacggctagagtagtacaaatttatttgtcacttttttcagaaacctaccagtatataaattgaggcatgctatagacactgtatagtatatgaaaaataagtttattttgggaaacaagaggaataccgtaaggttataccaggagatggtgttgacatgtaagttcaggatatagtccaagttaaaattctcgtattttactagctctgtaaacttagcaaattacatcatcatatcatttacctgagccttattttcctcatatgttaaacggatatacaaatgcatggctcttagccttgtgagaagtaaataagaaacttctggaaagaatatgacttgtcacttgcttccataatgcttaatatgtgccaggcactcttctaaacacttcacatgcattgactcattcgatactcaccctacgaggcacatactattctcaccatccccatttcacaaataagtaaactgaggccaagagaagttatgtaacttacccaaggtggcacaactagtatttgatagaacgaagatgggaacccaggcagcctggctctagaattggtgctcttaatcacttcactccaaaaaagttacggtagctcttttctttttttctttttctttttttcttttttcttttcttttcttcttttcttgccttctcttctgttttcttttttttcttttcttctgttttcttttcttttctttctgtcattttctttctgtccaactgtagtcacttttttgtctattcaacaaatagataaagtgtaaggtgatgtgtggttcctgccctcactaacgttaccctgtcattgatctcaactgccttcccttcactgaagagaaaaaaaattttctttgatgacctaaactgggcactctgatgtgaagacatcatcatggacttaagggcaggtctgatttcatgggcatgcaacctgtacagtcacacaaggccccaaactcagaagggccttacctttggtttaatgctctgttatcaccaacttgaaattcttatttatttattttattatactttaagttctagtgtacatgtgtacaacgtgcaggttttttacatatgtacacatgtgccatgttggtatgctgcacccatcaactcgtcatttacattaggtatatctcctaatgctatcccttcccccttcccccaccccacgacaggccccggtgtgtgatgctccctatgctttgtccaagtgttgttattgtttagttcccacctgtgagtgagaacatgcggtgtgtggttttctgtccttgcgatagtttgctcagaatgatggcttccagcttcatccgtgtccctataaaggatattaactcatccttttttatggctgcatagtattccatggtgtatttgtgccacattttctttctttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttttttttgtatttttagtagagacggggtttcaccgtgttagccaggatggtctcgatctcctgacctcgtgatctgcccgactcggcctcccaaagtgctgggattacaggcgtgagccaccgcgcccggccgccacattttcttaatccagtctatcattgatggacacttgggttgtttccaagtctttgctattgtgaatacagccgcaataaacatacgtatgcatgtgtctatatagcagcaagatttataatcctttgggtatatacccagtaatgggatggctgggtcaaatgatatttctagttctagatccttgaggaatcgccacactgtcttccacaatgattgaactagtttacagtcccaccaacagtgtgaaagtgttcctatttctccacatcctctccagcacctgttgtttcctgactttttaatgatcaccattctaactggtgtgagatggtatctcattgtggttttgatttgcatttctctgatggccagtggtgatgagcattttttcatgtgtctgttggctgcataaatgtcttcttttgagaagtgtctgttcatatcctttgcccactttttgatggggttgtttgattttttcttgtaaatttgtttaagttctttgtagattctggatattagccctttgtcaggtgggtagattgtaaaaattttctcccattctgtaggtcgcctgttcactctgatggtggtttcttttgctgtgcagaagctctttagtttaattagatcccatttgtcaattttgggttttgttgccattgcttttggtgtcttagacatgaagtccttgcccatgcctatgtcctgaatggtattgcctagattttcttctagggtttttatggttttaggtctaagatttacgtctttaatccgtcttgaattaacttctgtataaggtgtaaggaagggatccagtttcagcttcctacatatggctagccagttttcctagcaccatttattaaatagggaatcctttccccatttcttgtttttgtctggtttgtcagagatcagatggttgtagatgtctggtattatttctgagggctctgttctgttccattggtctatatctctgttttggtacccgtatcatgctgttttggttactgtagccttgtagtatagttggaagtcaggtagcgtgatgcctccagctttgttcttttggcttaggattgtcttggcaatgcaggctcttttttggttccataagaactttaaagtagttttttccaattctgtaaagaaagtcattgatagcttgatggggatggcattgaatctaaaaattaccttgggcagtatggccgttttcatgatattgattcttcctatccatgagtatggaatgttcttccatttgtttgtgtcctcttttattttgctgagcagtggtttgtagttctccttgaagaggtccttcacatcccttgtaagttggattcctaggtactttattctctttgaagcaattgtgaatgggagttcactcatgatttggctctctgtttgtctgttattggtgtataggaatgcttgtgatttttgcacattgattttgtatcctgagacttttctgaagttgcttatcagcttaaggagattttgggctgagatgatggggttctctaagtatacaatcatgtcaaccacaaacagggacaatttgacttcctcttttcctaattgaataccctttatttccttctcctgcctgattgccctggccagaacttccaacactatgttgaataggaatggtgagagagggcatccctgtcttgtgccagtttccaaagggaatgcttccagtttttgcccattcagtatgatattggctgtgggtttgtcataaatagctcttattattttgagatacgtcccatcaatacctagtttcttgagagtttttagcatgaagggctgttgaattttgtcaaaggccttttctgcatctattgagataatcatgtggtttttgtctttggttctgtttacatgctggattacatttattgatttgcatatgttgaaccagccttgcatcccagagatgaagtcaacttcattgctgtgggtaagctttttgatgtgctgctggattcggtttgccagtattttattgaggatttttgcatcaatgttcatcagggatattggtctaaaattctctttttttgttgtgtttctgccacgcttttgtatcaggatgatgctggcctcataaaatgagttaggaaggattctgtctttttctattgactggaatagtttcagaaagaatggtaccagctcctctttgtacctctggtagaattcggctgtgaatccatctggtcctggactttttttggttggtaggctattaattattgcctcaatttcagagcctgttattggtctattcagggattcaacttcttcctgttttcatcttgggagggtgtatgtgtcgaggaatttatccatttgttctagattttctagtttatttgcatagaggtgtctatactattctctgatggtagtttgtatttctgtgggatcggtggtgatatcccctttatcattttttattgtgtctatttgattcttctctcttttcttctttattagtcttgctagcggcctatcaattttgttgatcctttcaaaaaaccagctcctggattcattgattttttgaagggttttttgtgtctctatctccttcagttctgctctgatcttatttcttgccttctgctagcttttgaatgtgtttgctcttgcttctctagttcttttaattgtgatgttagggtgtcaattttagatctatcctgctttctcttgtgggcatttagtgctatgaatttccctctacacactgctttaaatgtgtcccagagattctggtatgttgtgtctttgttctcgctggtttcaaagaacatctttatttctgtcttcatttcgttatgtacccagtagtcattcaggagcaggttgttcagtttccatgtagttgagtggttttgagtgagtttcttaatcctgagttctagtttgaatgcactgtggtctgagagacagtttgttataatttccgttcttttacatttgctgaggagtgctttacttccaactatgtggtcaattttggaataagtgcgatgtggtgctgagaagaatgtatattctgttgatgtggggtggagagttctgtagatgtctattaggtccacttggtgcagagctgagttcaattcctagatatccttgttaaccttctgtctcattgatctgtctaatgttgacagtggggtgttgaagtctccagttgttattgtgtggtagtctaagtctctttgtagatctctacaggcttgctttatgaatctgggtgctcttgtattgggtgcatatatatttaggatagttagctcttcttgttgaattgatccctttaccattatgtaatggccttctttgtctctcttgatctttgttggtttaaagtctgttttatcagagactaggattgcaacccctgcttttttttgttttccatttgcttggtagatcttcctccatccctttattttgagcctatgtgtgtctctgcatgtgagatgggtctcctgaatacagcatactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgtttttgcagtggctggtaccggttgttctttccatgtttagtgcttccttcaggagcccttgtaagtcaggcctggtggtgacaaaatctctcagcatttgtttgtctgtaaaggattttatttctccttcacttagtttggctgcagatgaaattctgggttgaaaattcttttgtttaagaatgttgaatattggcccgcactctcttctggcttgtggagtttctgctgagagatccgctgttagtctgacgggcttccctttgtgggtaacctgacctttctctctggctgcccttaacattttttccttcatttcaactttggtgaatctgacaattatgtgtctcggagttgctcttctcgaggagtatctttgtggcgttctctgtatttcctgaatttgaatgttggccttccttgctcggttggggaagtcctcctggataatatcctgcagagtgttttccaacttggttccattctccccgtcactttcaggtacaccaatcagacgtagatttggtcttttcacatagtcccatatttcttggtagctttgttcatttctttttactcttttttctctaaacttcccttctcgtttcatttcattcatttgatcttccatcactgataccctttcttccacttgatcgaatcagctatcgaagcttgtgcatgcatcatgtagttcttgtgccatggttttcagctccatcaggtcatttaagggcttctctacactgtttattctagttagccattcgtctcatcttttttcaaggtttttagcttctttgtgatgggttcgaacatcctcctttagcttggagaagtttgttattaccgatcgtctgaagccttcttctctcaactcatcaaaataactctctgcccagctttgttccgttgctggcgaggagctgcactcctttggaggagaagaggtgctctgatttttagaattttcagcttttctgctctggtttctccccatctttgtggttttatctacctttggtctttgatgatggtgacgtacagatggggttttggtgtggatgtcctttctgtttgttagttttccttctagcagtcaggaccctcagctgcaggtctgttgggagtttgctggaggtccactccagacgctgtttgcctgggtgtcaccagtggaggctgcagaacagcaaatattgcagaatggcaaatattgctgcctgagccttcctctggaagcttcgtctcagaggggcacccggctgtatgaggtgtcagtcagcccctactgggagatgtctcccaattaggctacttgggtgtcagggacccacttgaggaggcagtctgtccattctcagatctcaaagtccatgctaggagaaccactactctcttcaaagctgtcagacagggacgtttaagtctgcagaagtttctactgccttttgtttagctatgccctgtccccagaatgtggagtatacagaggcaggcaggcctccttgagctgtggtgggctccacccagtttgagcttcccgggctgctttgtttacctacttaagcctcagcaatggcggatgcccctcccccagccttgctgccaccttgcagttcaatcttggaccgctgtgctagcagtgagtgaggcttcgtgggcttggggccctccaagccaggtgcgggatgtaatctcctggtgtgccatttgctaagaccattggaaaagtgcagtattagggtgggagtgtcctgattttcctggtaccgtctgtcatagcttcccttggctaggaaagggaattcccctaccccttgcacttcccagatgaggcaatgatccgacctgctccatgggctgcacccactgtccgacaagccccagtgagatgaacctggtacctcagttggaaatgcagaaatcacccgtattctgcgttgtccacgctgggagctgtagactggagctgttcctattcggccatcttggaacctccctcccttgacattcttaataattttatccttgaacttgtgttttataagtgaagtcctaggggacaagggagcatgaatgagcagaggagacatgtgcaatatgtgtgtcccccactccttgctgccctgctcacatattagcattagagatgctcctatgaacacagaattccagtggtctcatgatgtaggggagttcagtgagacataaatcaagtataagataaatgtgttacttctatgactgagtaagcaggaaagtgagggactgctgacatcctggagagggcacatttttcattccaacaggaacttgcttcagacacgcagcaagaggataagggcattctaagaaacatgtagaactgagaaaccctgtcgtatccattcttactcctgttacttccccatattagccaaccacttacactgaaaaagatgatattgaagtaaagggaaaagatagggtaatccataatttcttttcctttcagtctttcgttacccattattaagttgaaggtagggagtgttggtacatgtggtcatatcaagaaggtaaacaaaaacttgtgaaatacatatgcatgtatgagctatgaaatatgaactgtgattttgtaaacaagtaaaatgttcctatatttccatttaaaactggcattgcacaatataaaaatgaatgttaaaatatacgggaatgattaaaatttttgattttgcattactcagaagaacatcaaatagatttaaaacaccatgagaagttgagagagactgcagaagaaagacaaaggtttatattttagtacacttaatgaaactttttactgctttttgaacaagggcttccacattttcagttttcattgccccctccgacccccaaattataagtggtacttcttgagggtagaaaacagcaagaaacataaaagtgaggttcttgaatagaacccatcaggaaacaagtggttggattgaagagaagaggatgtgagcaaatgaatagaggacattttatttgccaagctgaaagaataaaattgattgcaaaagcaaaaaggattagcacattgttgagcaaaaaaaaaaatgtattttatgacatattgtgatacatacaaatgatggtttttaaaatactgatagaattctcaatgcaaacactcaaggaagcaagcaaccaggccaataaataaccaagcaaacaaacaagcaagcaaatagccaacaaacaaaatagtactttaagttctagagtggtggacaggataaaatagagatgaactggaggctgggacaataggtgaaagaaggttgcgtttgatagaacgttcaaaatattaaagagccacttaagatctaagaataaaaccacagcagtggtcttttaatcttagaagagccatcatttcacatttagagcctttcctttaaatgtgtctactacctgaagtaacctctccttccagtcttttctcagaagtctcttcttgaaagaaaatgcagttagccttttattattttttaaatgggcccacagacccttcactgtaacagctcatggactgagagcctttctcatagctacagcccttgggcagagtgtgctcaagctgcacaaggccctgtggacaaaagacaaacacccagatatcaaggtaattaccctggagaccaaacatcatgctgtttgtttttctgccttgtctggtcatctcctccccttgctgctgtattcatgcttgaaggaacagatgttattcatgctaaaaaagcaagcttcttgtcctccttgctcatcaagcacaactcatttcatgctggtgctcgctctgcgggtaataggtgcatttaataagactggccatcactccagaatgacagaagagcactctacagaggtcagcggctttgggccatgtcctgtgttaacagggaatggggcaacgctcgcaaggagtaagcattttgttatgactgcagcctgacttccaaccttgttcctttccaactccccctggctctgaacatggaagacactttccttccaaaagcagctttataaagagtgaactctctctaatttatttagcttttcttgtgccaatatcctaatagttagacagcaactcccagtaagtggttgattacattcaagcaaatacacagctgagcaattaagtgcattcacttgcaccttagaagacctgaggtggtaggattatctcatagaaataattatggctgctctatcctgcctttctgtcgtttgggaaaaattggctcttgaagttggctttgggtcaagggagctgttgcctggctgtttctgactgagaagtatttagatgtattgtttttttttaaattaggtttacactaaatgtcataccagtctttcacacaatggacacttacaagctgagaacagggatccccgtgcccaatatagatagacttggtgaatcaggtgattttgtatatattatgtgtattttaattttcaaagaatcgttagcaagcatttctttgggaaacattatagtcttatggaaagaacagtcaagaagcaggaaaacagcatcttccagctctttcgctaattggatagttgaccttaagtaagcctctaatgtctctgtacctcagtttcccttactattattacctacctcatagagttgttatgagatgcaaatgaacagtgcataagaaagtgatttatagactgttgaacattgcagatgcaatgcaaaactgttgagtttaggtgttgcactgttaggtgggtgcaaccagttaaacagaaataatttgttcaccaaagaattttgttctgcaggagtgaggtgagactagtcagggccagatactgtaataataactataatttatataacaggaaaatggggatgtgggaggggagactaccatttgttaaatgcctcagtgacagtcaaaagcattgttacctcactgaatccccacaatgactcaacacatttgcatcagaatcacccttcccaaggctactgcaggaagagacagaaaatcggggtaccttgaaataaaaatgaagaactgctttcgtatctaggcaataaatagtagaagtgtgtgaaattggtgatgatagctaaaattttagaaagcagcatggtataagcaggagcagctgtggccaagcctgaacaaaaacaaactggagaactggagggaaaccatgcatgggataaagataaaagacaattagaaaagtggtcttaaaatgcttcataacatggtacattaattgtacgtaggagtattgtcaccttttctactcgctattgtagtcctgttagtgtgcttatggttataggctgaatgtgaattaatttattggttttgatccaaatacactataagggtatatatcgttacatcctcatatctttccgttatccacacacagctgtgctgtatctaatttatttatctagaatcaatttatgccagttacacaaggtgaaactgtagtgctggacagtttctgtaggaattgcatggcagctcccaagtacaatgtagaggcaggcttactataagcaactattaccctatgaggcaggcctactataagcaaacacctgtctagagagagggcaacagagaagattccttagtaatccagtctgcctttctcttggcaaactcttattttataagcctaggtcatgttgtctacaatgtaatgtttatgttagtatataaactaatataactttctcttgatagttaatcagctaatatgtagattgcctggcacataaagcatttcttcatttttgtttattcagccagttctttctcataatatcgcatattgtaggtgctcaaaacagatgaacacatggtttctattgccattcttattagtagaatcctttctttttgctttctgaaagtagataatcatgaaattaaatgcattctttatcaagttatttaatgtgcagatacttcttttagttttccatcattgttaaccaagtcaataaattaatccatgtcagaagtctagaactcaaactgacccaaaccatccttctccatttcccttgtatccttaacctgaattttttgtcctagtcctccaggctgccctgatttcttcccaaaagccacattggtttttttgtcctgaaactttaacatccttctatctctaatttcttacctcctatagtatcagatcagacctacctccattataggtctttgcctcaactctccagcctctccaacctcccttcagcccttcttgcctgcaaccatgattcacacctaaaagcattctaatctgggttcgtttgcaaattgttttagtctggtcacactgctataacaaaacaccatagactgggtggcctataaacaacagaaatttatttctcacagctctggagcctggaaagtccaaaatcaagttaccaacagacttggtgtctggtaagggcccgcttcctggttcactgatggctgtcttttcattgtaacctcacatggcagaaaaggcatggggtctctctcaggcctgttttataagggcaagctaatcccattcatgagggttgtcctctcatgacctagtcacctcccaaaggccccatcttctaacaccatcaccttcggggttaggatttcaacatacaaattttggggaacaaaaatattcaaaccacatttgatgttctagatcggtgcttacaagcacttgggtttcatataccaataacatttcaaagcctaattaggctactgggcattagatttacattctttcctgccctagaagagacttttacaaattatttgtgatcctaatttcatttctaatgaccaatttcactttaaaacagcgaggaggcattacactccgatgcttagatcttacagaagaaaagcactttaagcctagtcatgagaaagctcctgaaagctgcattgtgatcagacccaaattactactgtcattgctgcatttcttcagagatatacactggttacttacatggcatgcaagatactagctgaaggaactgagatctgtgaatcagatatgaatgctgcccttgaaaaatgtatcgttgagtaagggcaaaatgatgtaaactcgtgtatgataggggcttacttgtcttaagagaggcgcaaagagagtggagttcattttcagagtgaagaagaatgggtaagtgctttctggaaaatcctgaagaaagcagcaattaaacttggagctgaggagaagggcattgcggtcattccaacagtctgaattattgtcccgagtgttcctttctgcctccaccccctgattttttaaccttcattttaggtacatcattgtgttagtctgttctcatactgctataaagaactgcacgagactgggtaatttataaaggaaagaggtgtaattgactcacagttccacagggctggagaggccacaggaaacttacaatcatggtggaaagggaagcaacatgtccttctttgcatggtggcaggagagagaaatgagcatgaaggtggggaaaaccccttataaaaccatcaggtcttgtgagaattcactcactatcacaagaacagcatgagggtaaccgcccccatgattcaattaccttccacctggtccctcccacaacacgtggggattatgggaactgcaattcaagacgagatttgggtgagacacagccaaaccatatcaatcattttacacacacacatgctgacagagtaaagaagaaagttattgcctgtgccccatatatctgatatgttccttaaagacattcgttcctgggtgacagtctcaatgagtgatgtaccagacaccctttgggtcccctgcaaatattaacgccattactaacacgatttggggaggggtaactcattgttgttttactttatgaatttcaccgtaggtgccctctgagctcagctagtcttccagcttttttcctctcaatgctgtttcacgccctcatgttctgcagacagctccatttataacagtgtgattgagtggagtagaggatgagtggaactgggaacaaacctaagggaatctatgaatctggtagtccttgtgcctcgtgggtcctcctggggcagcaattcacaacagtataagtggctgtgggttgtgtgtagacctttggagtttgtttggtgctagaggagcggctacatagaatttccaaaatgactcctgcatgcacaagagtgacatagaagtacaagtggctacagagtaagccgaaatagagagcgccttagacaatctcaaggagtttcctgggaatggagtaatctgtgtcctcaaaggtaacatggacatagaagcaaacaatgccagacccaagagagtcttgtgaacagaatcaaagtgccggtgcatagcattacatgacccacagcctatattttaaaattatttttctgctctttcttttcatattgtaagtattgggctactataacctgatttttttatttatgatgtttatttgtgaacatcagtggtcagccttgacatagcaggcccttctaactgcttatgaaatacattttatcacaagagaaaaaggaaaattgttccttcttgtgtgcagttgcagaaaggcagacagtattttgcattgtagaaggtatcctagaaatgttacctctgcctcgggaatctcaaaagagactcagactttagagagtgttgttatgtcctatgaaggtttctgttagtttctaaaaaaaaatctgtaagtgtaattccaattgtcttttatacaaatgtggtgtcctcgtattaataattaaattggattatctggtttgcaaaaagtataaaatcatgtgagggctcttctttagaacagtagaggatcactggcagcacacatggagatttaaaaagtataaattttcataggttgggttccccaggaagcacacagaatttagcatataggatgtgtttttttgttttgttttgttatttgttttttgttttttgtttttttttttgagatggagtttcactcttgttgcccaggctggagtgcagtggcacgatctcggctcactgcaacctctgcctcccaggttcaagtgattctcctgcctctgcctcccaagtagctggaattacaggtgcctgccaccacgcctggctaattctttgtatttttagtggagacggggtttcactatgttggccaggcgtgttcttgggaccaatccctgtgtaagggaggagaaaggaagcagggttaggtagatgggaaggttgaactgtgaatgctaacctgacaacagcctcagctgacctaaccccgggaatgtcccttccaagttgtcctgagttcaccaggccattctactcccacataatcagtctttttctactcccacataatcagtctttggatatgggccaccacgcatggtttgctggagctagctcataccagctcccatgagctgactgtgtgcatcaattcccattctgcattcagtgaagtcagtcatgtcagtatcttgaaatcggcaatgtagggagtatttacatcacagaaattggaaatcgatcaatctgggcttgtttgtttattttattgaagagccacttcttaaatatttaccaggaccccgctgttaccatggggtcttgagtgaggtatctctccgaaattagggctgagagtggtaggctgtattctgacagtgcttctagcagctggaggttacacaatgtccaccacaactatgattctgttggcttcctatttaaagaaagagtttggtgaagttttgactcatttaaattaacaaatggtcttataaatggagaaataaactgagcaaggaacagatgactgagtatggtgagcccacactgacctcaggtaggacctggcaaaggcgaaaaaatgaacctccttcagggacatggtgaggattctggacacctctggattatacctgtagattgttgggaactatgttactaaaagactatttttggtagaaaaccactgaagtattatttttttttttgtaatcgcatagtatgggttgaggtttttgttgctgttatgatttcttgtggcttttcccaaacttgtcatggggatagatttacaaaatagttggctaatgctgaactcagagacctgaagaactttttctacattttaaagttgatcaggttaaaacacaatgtaaattgagaagtgtgggttatcattttttaagagaatggagacccttagaactgcaaatagaccagattttgtacctttggtaagcaggctgtctttcctcactaataaggagttgccacccttctggaggatgaatatagggcttaaaatttggatgatggaaagctcagtggcatgaatgtgttttctcttccaaatgcatttcttcccatgtcttgtagttttagccatatattgttgacagagtacaggagcatgagaataccaacactggaataggtgtgattgacacacaacagctaagctatgtactttgaattaacattttcagtaatgcgagtatatatgctctcctgccccaattgtgagcctcaacacacacgttcaagatggttgcttgggacttagactacagttggtagtcttgtggtgggacaaatctaacccattccatgtggcagtaaacatattgtaaacttaagctcaccctttgacttgataccttgtctctaatcaattagcatcataagtaatttgtgatgtcacctatattaattaagccactcttgcattgctataaagaaatgcctgagattgggtaattataaagaaaagaggtttagttggctcaggattctgcagactgtacaggaagcataatggtatctgctcagattccagggaggcctcaggaagcttaacaatcatgatggaaagtgaaggaggagcaggcagatgatggaaggtgaagggggaacaggcatgtcacatggctggagaaggagcgaggtggggaggaggtgctacacacttttaaatgaccagatctcacaagaactcacacactatcatgacgacagtaccagagggatggtgctaaaccattcttgagaaatctgcccccatgatccagtcacctcccaccaggccccacctccaacaatgggattacatttccacatgagatttgggtgggaacacacatccaaactatatcatcacccatagtatctcggctgttccatcttaaaaatgcccaaaaatctagttttaaaaaaactgttgcctattagtattccagttcctgggagcataccttccagcttaatgtaaagatttcctaagagtatttcagttttttactttcactcttggaaacagagatttcttaatgcccaataatagtaataggtttttaaaatttatgcaattattatgtgctaggcactggttctatacattttatatctctacttctttttttttttataacagactcaggaagtagatactattgttatcatccccatcatgcctagaaagattaagtaatttgccagaagacacatagctaatgtgttacggaacccggctttgaatccaggagtatttcttcagagctcacactcttaactactatgctatattgtgtctcaacataaatttccttcataaactacctcgcctcatttttgtctgtctcaagaacctagcacagtgcccctacccaaaattattccgtaagatagtggatggagtatgagtgaaactcagaatctaatagtcacatggctaagccattttacccgtgtgccattgaaagaaagtcatccaaaaagagattactataatgtgggatgtaactcttatttgctcttctcactgaagaattctgtctactaatgcagcagccagtcaaattggttcttaaattgtcttcccttgagcaagagttgggaaagggaaggaaaaggtggagcatgaatggcagtatttctctaactttgatgtgaaaatggtaatcttgctaaaatgcaaattctgatatggtccttctggggtgggaccagatgttctggatttctgccaagggcccagttgatgatgcagttctccagactacatgttgagtagcaagagcatagcgtagaagagctccccctacaggcctgcaatgatgcgttttggaaataaaaaagctattgtaccggggccatgtaatcaaccgcacacaaacagaatgggggtgggggcggggcggggcggggcgggggcggggggaagaaaaggttaggggaagtacaagtgaagaaacatgtaatgcatttcaatttactgtaccaaaataagtgagaggagagatttgggcacatgaaacctggagcaatgtatttagttctggctaataaacctgagtgcaaatgtttcatttctaaccataaggttctaataattataatggttatgacaggcatcatgtttatcacatattctaaacagaagaacataacaacttactagaaacttttgattatgtgtacataagtaacctactttgtgaatgatcctccagagatatgtttatcctgcactatgctttgggttgctttgtctcaccatcacatcagtttgtgtgtgtcctgagatcatgaatttgttttaaaatcatctaaagaaaacctcaaagtctgttattttattttattttagatttggtggtgggggggggcggtacatgtgcatgtttgttccattaatatattgcgtaatggtggggattaggtttctagtgtacaaaccttgaagtctttatgtgtgtatatgtatctgttaggaaagatataaatgagtaattttatgctgtttagtaattcctgagccatcaaccaaggccttaagatctgtctgtgctggattgaatcagcagatatatgtttgatttatttaaaattcttgaataaatttaactcaactctagaaaaataattctgtccctaagaatgaaaattctcaaagctgctgttgtgacaagttagatcattttgaaaatgagggattgaataggtaaagaagccatatttcagagatacgcccaaatttgacagttcacctgtatcaggctgtcattcaagacgttaactgagaaaagcaattaacacttcacctgtatgggctaacgtgtttattcattaataaggttaaaaacccattttgtgttttatggaagatttatgcaaataacagacagcaattaagatgcttcttgcccagatgtcactatcaattatgagacagattcctatagattgaagatgagcatggagttgacttacagggaacctgagcaacataatcaagtgtaaatatgatagaacagtgctagtttgggaatgtaagcaaacaaaaaaagtaaaacagaaaagaaacctaaactctgatctgtgtgaaaggtctgcagaaaacgacttaacactttgagataaggtaaagcatgtcagaatgagctgggggggagaagagctagagaagcaggcaggcaagccagaaggcggacagcaggaacctccaggtgaatgtgaatgaggcctgggtaaagagagacatcgagaagcagtggaacggaaccactgaagtgcaaagataggaaaggaaaatgtgtcaaggaatgcttcaggtacccatggcacaagtgatttcaagaactcttgaatcagagtagataagtccctgttgctacaagcacagcttacggaaaagctggagatggttatctgacaactgcctggagtgcccaaggagacagagaggagcacttgaagaaggaggtcctacaaccatgctgggtccaagtggtgtctgagattgaaaacaaacaaaaaaacacttaacaaagctaggattttgttttcttttcaatgttcaaaaacacttggatgaaaaaacacaaccatgtctgcctccattttccaggaaggtcatttattcacagaaatgttttttttctcatttgcttgcttgcttgcttgcttgcttgcttccttcctttctttctttctttctttctttctttctttctttctttctttctttcctttctttcctttctttcctttctttcttcctccctcctgccctgccctgccctgccctgccctgcccttctttttttttttttggagatggagtctcgctctgttgcccaggctggagtgcaatgacatgatctcggctcactgcaacctctgcctcccaggttcaagtgattctcctctctcagtctcccgagtagctgggattacaggcgcacaccgcccgccacgtctggctaattttttgtactttagtagaaactgtgtttcaccgtgttgcccaggctggtctcgaactcctgagctcaggcaatccacctgccttggcctcccaaagtgctaggattacaggcgtgagccaccgcacccagccatttttctcattttcacttcaagttgacaatgttcctgactctttgcataggtatttctatttttatattaacgtgtctggatatccatcgagttttccattgcaggggactagaaaatgattttgtgagtttccagatttgatgttgttttacttcttctgggaaataccaaaggttattgatgtagttcggatatttgtcccccacccaaatctcatgttgaactgtaacctccagtgttgatggtggggcctggtgggaggtatttggatcatgggggtgggtccctcatgaatggcttaggccaaccccttggcgataagtgagctcttactgtgagttcacatatgatctggtcatttaaaagtgtggggcacctccccaccactccactttctttcgcttgttcctgctttcaacatgtgaggtgcctgctccccctttgctttctgctattataagctgcctgagaattcaccagaagccaggcagatgccagcactatgctttctgtaaaccatgcagaactgggagccaaataaacctcttttctttataaattacccagtctcaggtatctctttatagcaattcaagaacagactaacacagttaaattcaagctcatgaaataaaactcataagcacagtttagttattttcatatctctgattttcagctcagatatacattagaaacacctggggagcgttttgctgatgctgtggtccccttcctgaaaaatttttattttgtttctctggggcagtgccaggattttagcacatttgaaaaactcttaaaatgattgtagtgcgcagccagagtcaagaaaggcgggtttaggtatggtgggaacaaagtcaaataatactgtaatacattatttgtaatgaaaagaaagattaaaattttagacataaagtatttagatcatgccagtatgggtgacatcaattttaaagttcaaaaaaaatggtaacaattgcaagaagttctggtgcttagagtgggtgctcattaagagtagccaaggacttaactattttttgtaggtcttgctttatgataattttttaaagattcatctttttaatatgaccagttaactaacgaaaaggaaactatgattttctcttgatagttagcatatttcattagctacagatgagatgattctttcctatctaataaagtgtattttccatcaacgtgaagtgtgattttattaggctggtcatacagaccttctttaattctcaaaagcactgtaccagtaatttacataatttgccacaaggtggatgtggatacctggattatgacctcatcatatgaatcaggggccaataaactatttctgtaaagagtaatgcagtaaatatttttgactttgtaggccatatagtctctgttgcaactactcaattctgccattgcagccatagacaatatgtaaacaaattggtgtggctgtgttccaataacactttatttacaagagcaggtagtgggctacctttggcctaggagccaaagtttgtcatctcctagtataaataggaaaactattttttattggtgtgctaaatgcaaatatcaaccattctttttctttcaaaaatgtaactttctattaaaatataaataggaggcttaaatattacaatacaataatagaccaaaattaaagaaatatgagaccctagaagcaacttttcccattaacctttaaccactttaattgctgcttagtttagctcctattctcttttcagactaaagtagaaatctatttttttttcagttaccctaaaacattttaaaagccagaagcccatttgttatacaaatacaggcaacaatggttttcagatcttagtttggggctttagaattcttggcctttacttccttctgttttcccacctttaactgcctgtctgtagttatcacagagaagatattacattatcgtatacctctcagttgcttttgcttttggatcactttccttgagtcccatttatttttcctgccctatggcaaaaccatctgtaaatacatatatacaacgcgatatatatgtgtgtatatatatatatgtcgcgttgtgggaccatgacctgagttttcataaaaatcttataacccttttccaaccaaagttttccctggaacccaacttcagaaggtacctgaacaaaaggcccagtgccttcttcacccgagattccttatcatggcagtagggggtggattaaagaaactgcaggcagatttgactgggggagtttatgaatatgtataaaaggtctgtgtttaattctgtgagtggaggtcatagaggtgaaagggtggcagtcctcatggggaagaacccatgctaaaatggtgtatcagctagggaatagggctcatgccaggacaagtctacatgaaaagggcctgagagagtgcccctatcccttgtttcctagggtagcaggcatgaagtaacacgtaaacgttttcttcagccttcattccaaagggcatggttgtaacacagagaaaaggagccagcccaggacagcaacagacatctgtacagacacagcccggttaaaggccagtgcccaagttcagaggaaatgagcaaaagacaatggacaacggaaagtacctgcagacaaaatgcccacatcacttaatacctgagagccatgtaactctcccagctctatttccagaagctagctgccacttcagagagtgagggcagaaggagcaaaactctaaattggctttaaaatattgaagtacctcagttattctgaatgtctaatattacatttttgccactagctgtaatagagtttcagggtaaaaaataactttaattttagtaaattatatgagaatgtcacaatttgcacacttctaactctaaagtttgctcctgctgcctatgtctggggagattggatggaccagtgctggaaggatcactgttcaaaataaagtgaatctactcatacatcattgtgatatgtgtataggccagcatggggattctggcctgaacacaaccattctctactactttgctgctctcatcctttctagaaggattccttggtatatctcatgtagtgaaaaaggctttggtacaaccttcatcatccaagaaatttggcaagaattatagagacaggcatatgtgggtctgcaaagctgaaaagaagtgtctcagaaaggaaaacgcttaagcagtgacaaatcctgataaggctgccttgcctgcagacagtggtgcagacctggcttccactaaagtgattctcgatcaccctaatcctaaatcaggagccacaaaacaactcaggcaccacattcctaaatcagtcacactccttggaaaagcttcaaggaccacttcttggaaaacctgccaacaaccagctcaacacttacacacagcctaaggaattggcctagacaatgccagacaatcagagggtctagtgggctttgctttcccaatatgggccacagagactgcagttttcagctttaagaaaacctatccagaatttctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagttttcagcatgaagggttgttgaattttgtcaaaggccttttctgcatctattgagataatcatgtggtttttgtctttggttctgtttatatgctggattacatttattgatttgcatatgttgaaccagccttgcatcccagggatgaagcccacttgatcacggtggataaactttttgatgtgctgctggattcagtttgccagtattttattgaggatttttgcatcaatgttcatcaagggtattggtctaaaattctcttctttggttgtgtctctgcccggctttggtatcaggatgatgctgacctcatataatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccgtttatcattttttattccgtctatttgattcgtctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttagatctatcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagtgagtggttttgagtgagtttcttaatcctgagttctagtttgattgcactgtggtctgagagatagtttgttataatttctgtttttttacatttgctgaggagagctttacttccaagtatgtggtcaattttggaataggtgtggtgtggtgctgaaaaaaatgtatattctgttgatgtggggtggagagttctgtagatgtctattaggtccgcttggtacagagctgagttcaattcctgggtatccttgttgactttctgtctcgctgatctgtctaatattgacagtggggtgttaaagtctcccattattaatgtgtgggagtctaagtctctttgtaggtcactcaggacttgctttatgaatctgggtgctcctgtattggatgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcatactgatgggtcttgactctttatccaatttgccagtctgtgtcttttaattggagcatttagtccatttacatttaaagttaatattgtcctccaagcctcttgccccagaacataaactctgtgccgaatcagcttccctgctgggcaggaaagctttcattcaggattcagtctttactcccagagtctttactttcttttgaacaattcttttggttaccactgtactattatctacacaatatatttgttttgattttataaaatttaacaagaagatattttattctctttggttgtatattacaaatgatatgagtgtcaccattattaaaagtgcagagagatcaccttaggaagtatgttgtcagtatgaagttttaaaaggttttaaactgcatcgttgtttgtaattataattcttaaccaagtatgtcctttccccaagcttttatgcttacatcgatctttttattgataaataatattttatatatttatggggtacatgtgatcttttgttatattcatagaatgtgtaatgatcaagtcacggcattaagagcgtccatcactttgagtatttatcatttctatgggttagaaagagttcaagtaatctctctagatacttttaaatatataacacattgttgttaactaaagtcactctactctgctatgaaatggtatgatttataccttgtagctaactatatgtttgtaccctataaccaaacttgttattccaccttcccacccacccttctagtctctagtatctgtcattctactctttacctttacgagagcaacttcttaatctccccatatgagtaagaacatgggatatttgtctttctgtgtctggcttattttatttaatgacctccagttctgttcatgttgctgcaaataacatgattttgttcttttttatggccaaatagtattccactgtgtataagtaccacattttaaaaattcattcatcccttgatagacacttaggttgatttgatatctttactattatgaatagtgctatgataaatatgcgagtgaaggtatctctttgatatgttggtttcttttcatttggataaatacccagcagtatgacagctggatcgtatggtaggtctattttcaaatttttgagaaatctccatactgttgtccataatggctgcgctaatttgcattcccaccaatgctgtataagcattccattttctctgcattctcaccagcatctgttatcttttgtctttttaatagtagctattctaacttggttgagatgatatctcattgtggctttaatttccgtttccctgatgattagtgatgctgagtattttttcatatacctgttagccatcttttgggaaacgtctgtgcatatcttctgttcactttttaatggaattatttggttttatgttgttgtttgaattccttttatattctgcatattagtctcttatcaagtgaacagtttgtatatattttctcccactcaacaggttgtctcttcactcttttgattgtttcttttgctgtaaagaagcttattagtttaatatagtcctatttgtctatttttatctttgtttcctgtgcttttgtggtcttagccacaaaatgttaacctagaccaaagtcctgaagtgtttcctctatgttttcttctagttttatactttcaggtcttatgtttaagtctttaatccatcttgagttatttttcatataaagagataaggttccagtttcattcttctgcataaggatatccaattttcccagcaccatttattgaagacggtatcctttcttcattgaatatgcttgatgcctttgtcaaatatcagttggctgtaagtatgtggatttctttctggattctttgttctgttccattggtctatgtgtctgttaacaccatgctgttttggttattgtagcgctgtaatatagttttaagtcaggtagtatgatgccttcagctttgttctttcagctcaggattgtttagctatttgagctctttttgttgttgttgtttgtttcatacgaattctaggaggtctttcacttccttggttgtatttattcctaggtattttattttttgtagctattgtaaatggatttctttctcagctatttcattgttggtatatagaaatgcaacagatttttatatgctgattttgtatcctgcaactttactgaatttatttagcagttctaagagtcttttgctggggtcttcagggttttctagatataagatcgcatcatttacaaagagtgaccatatataatctatttttaatggacactttttaaatacatagcctcatcctagtaaatatgtattgtcacagttttgacatgttcgttttatttttctagtatcccttaaaataaataccaagcaatttaaagtgtttgttcatgcattaactggaataatcacacactgggaaacataaaattatggcacaagttgtagtttagggtatattgaggtagaaaactgatgcctacctctagtccctaccacttttggctttacctttatttccctatttttcaattcacaaagatataaaccttaaaagggaaaaccgtgtggagtatctagatatgagaccaggctaacccttcggttatgaaaattttcacattttccactgtgatggttaattttgtttgtcaacttggctggcccatggtgcccagatatgtggtcaaacattatttgagatgttctttgagggtgttttgagatgaaattaaatcatttaatatatttaaatcatttaactttggggaaagcagattgcccttcgcaatgtaggtgggcctcatccaatcagttaaaggtgtgagtagaacaaaagactaccctctgtggagcaagagattacaaagcagctttcagacttgaactgcaacattagctccttctgggtctccagtctggcagcctcttccatcagattcttgactcactaagccttcacaattgcaagagccaattccttagaataaatctttaatatatatatatacacacacacacacatcctcttggttctgtttctctgtagaatcctaatacagcttacttatgtggaaaagtttattcattttacattatagcaatcagttaccgaacaaacattgcttggggaactacttgtgctttggatgataccaaaaagtccataaaatataatatagctcctgtcctcaaggggttgacaatctgtttgagggaacagtatgcatgcagtaagatcgccactaaccccaaacagcagaacttgtgtcaatatgtcgccatggaacacagaagctgtattcaattaagaaggagagtatcccccggcttggtggggttaaggctgtggttctctcaatgtggtcactagacccagcatcatcagcatcacctgagaattcattgcaaatgaaaattctctggcctcactttcaatctactgattctgaaactctggggtggagccagcaatttatggtttaacaagccctccaggtgattctgatgcaggctgaaatgagaaccgttgggtttgagaaaacctcatggaggaggcgacattttaaccaggccctgaaggctgagaaacattcagggaaggagtagagagggaagacagttcggcttggaaaaacgtctggaagagacacgtgagtaaaagaagcgtgtataaatattggtcaagatacaggacagtgacaaacgtgagtcgaatggtttgaaaaggagcgtacagttaaaattggctagtttgcaggtagatacattcagaatggagggagcttttttggactttctgcttaaggggaccagactgagtttcaaagataaaacatgacctgtattttgttttcttagaaaagtttgccttcatcttcccgtctagtgcagtgtttcttaaagtgcaagccaaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaagtgcaagccaaaggctcccagcatctgaatcactgggagtctgcctaaataagcagatcacctggccccaccttaactctgtctaccaaatcagagcatctgagatatgggtgataaaatgacattttacaaaagagtactccaagtaatccttatgactcagttgaatactgccccaggggtccccaaactactgtctgctgcctattttatcttgtctctgcaagataagaatgttctttacatttttaaaggattgaaaaaaataggactcttttgtgacatgtgaaagttttatggtatccaaattatagtgtccgtaaataaagtttcattggaacagagccacagccattcatttttggctatggctgccttcatgctgcagcagcggcagagttgaataattgcagcagaaaccttatggtctataaagccttaagtatttactacctagcctttcatagaaaaggtttgcttttcccagccctaggtgagccacaagatctgtgtgattttagattcctgatctgctcgtgctgataatggggatgggtacaaatgcccccttggagctaagagaaggtgacaatcctagagcttccttggcgtccagatagcagacacttagagtctcttgatgccaagaaatctcaggaagacgcttggaggggccctgtgcagatgaacatctccagattaggagtcttacattgggaggaacaagctgttttatctcctagtgacaggtctggttattatggtgatgggagagggctaaattgggagacattgagaaatactataatggaaggcatttttcctgtaagttatgaatgtgatctggacagagatgccttcgaatcggacaagttcacgattaggtaggctgcatgacgtcagtaaaattttctaggattctgtgaaccaagcctgtctttgaattttttacattaaccctagagcaacaatatgtatggctgctgataaaggagctctagatcaagaaataggtaaaaggaaaattctggaaggatttaaattctgcagtaagaggtctttttattatgtgaccaggaaaaatgcagatggtttagggttggacaaagtccatttcagagtctctctcactcatacacacacacacactgagtgagagaggacacaagcagacaagaacactggagttcagctcagacccacagatgctaggatggtggctaagataccagtgttatatacaaaactgttacctcattcaacccaggccatagagtagatgggggctctgtagtctgtaatggagtgagcagaaaaacctctcttgacaggcacagtgagtctcagctttaaattttgtggcatagctgtgaactccccagagaaaaaggcagccaatgaaactgccccgcaaagagcaattaggatttctgagacagaactcagagcttcctctgaggcaaagagacctaagcacaaacagcaccaaataccataagctgtctgcacagaagcaaagcaaaggtattcttttcatgtgtcagggtggggctctcaggcctgtattggcctttcaccatcgtgatcagaaacacgagttgctgatgtaaaggtcagcagcgtgcattgcttgtttctaccctggtgaggagagttttccccgaccgaagaatctaattggttgctgatgactcacagatgctgaagtccacaggcagaagcacttgattggctgtcactctgtttcagcattcccggccttgcaggtctgtaatgaatggtacagagggagcaaaagctatcatttgggtcaattaatatgatgagaaggggtagagggagctatcttctcccacacacctaacctaatagctatttctgctgcttcgtttagtcattgctgcgttagaggatgcctttaagaaaagtagttcagtagataggaaacttttgaatgctacgtaaatgtcaactgtttttattgttgtttttcctctgcttacatcagtgaggtgagggttacaagcagcgggacaaatacagaaacagtcgtgacgaaaagctcaaggatgactctggcggacagaaaggctgggggatacgaaatagagcctctgggacccagttctaatcttagcctggttttgacgcttgtctcagaaacctgcaagagacatctacaagatagattttctttctttttctctctaatctcagtgctgttaatttccacaggactttgaagctggggctctcagatcacacaatggaatctttcatacatacactgcgtttcaaatgcttaattgctagatcataagaaaatttgtgtgtagggctcaacatgcaatattttgtattcatggcaacatgcaagtaaatgctattatccatatatgatgaagagactgaaaatcagaatggctaggaaagttgcacaaagtttttgggaaggtgggaaaacccatggggaccccagcacctgcctactgatagtggaaaaacaagaaagcgataattccgcatggtcagagagcctagcactcagggttctgatttatggacccttgaatctggacttctttactaaacacttatggagccttctgtgtgtcacatcttgtatgtgctggagtataaaaataatcgagaagtggattttagtttcaatttgctcacagtccagtgagggaagggactcatatgttagggcaaagagacggcttttcccagggtgacatgagagcatagaggaagagcagcttaccagctgtggaggttaaaatgttcaaacctcttaatcgttgtggatcccaactttacgatcttgatttaactttggcctaggcagagatcgttgacatggtgtccatggatagttatcaggaattctttgaagctcctgaaaatgtctatacattttgatccatatgtgcattttagataagaaaaggaccatgttcatactgatgaagactctaagagttcttccacttctgacaacctagatatttgtctaagtatcaagccaggagagatagaaatgaaataatactgtattaataactctgcctagaaaatatacaaaagtggtatatagttgaaatgacaatttttaaccaactagatatccttttagaagacttcaaatcaaaagtctcactgttactgagagatcattaaaaccagagtttctacagagaggttatgccattgagaagttttgctgtagaacttccaaaaaacaaaacaaacaacaaaaaaactgaagggcatacctgggacttcagaatcactttattttctgcaaaagatattaaaggcttttatttactttggagagagagttaaccctatggaactattaggggccaataagccattgaatccagatgaattacctctgtaaaagttaaagaaggtactgagggaggttaaagagcatctggctgagaatccttttataactcataatcccagccagtccaattctcgttccggcagtcttccaggtctcacagctggagcctcctaaccatgacctacaggctcagccaagcctgggcacttggaggctggaaacaaaatgttcttaagttgggaacaaattaaggttcctggatcatgagtttgggagctccatgttttttcaactttgtgtcccgctctgaccttggaccaaagttctgcagttgtagcttcgggttgctctttagtgattttaggttttgccatttgatgtgtagggctctgcttcgcttccagataattatctagcagaattctagagtcccttgttgattcaccacttttgttcttgagattagggtctgtatgagaggcgcactcaatcattgctctatctgcattcactgctgtaagaccacaggctatcaaacagccttcctaaactagcctctctttcttcttcctcattttgactccaggctcttctaacctcacaacttgactgctcttggctgtacggtgatttgtttatttagtaccttggccttggtcatgtcctgtgtagcccctccctatgatgcctgattgttctgccccaaagaaggccagatgtggtgtctgggctgttaaacagggaacacagtacaatgccaaattgtgtattataaaacaatgcattatgagaaaagacaagaatttgctatattaacaaaagatcaaaagcaaatttaggaagtttagagatcagaagatccattttaaaccatgaagtgatgtggaagagtgtttagggaaaggattatgtagcattagaaatgcataatggttaacaaatcattactgatttataaaaagtctcaccttgataagcatgtgttattttaataagtgctactctagaaggaagataaaagcaaattaagggaccccatttatttcctctaaaagcctaatgccattccaccgaaaagattaatatgtgatgacaatcatatacacatttacatggtattaaataaatggcttgagagctattatagggttgaaaaccaagaatgatggacagaaatcactgtcaaatgatgcaagctgaggacttggatgctgaaaagactactatttgttggcaactattcatctattggctggataataatagaatatgtaacattctgagtagctaaatatttgcagttgggaggtgggagagagtgacttgtgcctggagttcaataaaagcaatatttgaaagctgacatcctctatttaatctcttaagaatgaaaactagaaggaagcataggccctctgcaagagtgtgttttactgggattagtaaagagggatggatttgcttccaagaattaatagcattcattaaataaagggcatatgagacagtattaaatattcagaagcagactgggagaataaaaaaaatcagattccggaacgaaatccaccattaaccagctatgtggtgctggattacctcatgcctcagttcccctatgtgtagaaaaaggtgattggtcactaagctctataagaacctcctgcctctaagacttgttttgatggagtgcccgtggcatgcatgtgaataatatttagtgactcgtgctcatccctgggttgctgtttcccccaacaccagcacaaatttcaatatttattgcctggtcttccctcatctcaattctgcacctgtttcccccatttcagtaactacaatgtcactgtgccacctctgctttgtgtctactggaaaaataatttacactgaggagctattggacagatgagtcacccttcccacacgcattgatttttccaaagaagatcaggaggaaagcaatgcataacaccaagaagtgagtggttagtgcaaagaattcaggcatcagagaggaggaggaggagatatttttgagagcgaaccttccagaagaccattccactactgtaaattcccttgcccatctttcttctgccttctatcccagagcctgaatcctagtacctccactcgttcagcagtgatcaatattaacatagacgtaataatgtaaacagcatttttatttaaataacagaggatggggatatgcagagggctataagtgagttcaagctttactatatttaaaaagtcatagattaaatttggtaaatacaaagtagcagcattcataaattaacagatatttgttaagtacttgtcatggacctggcattattccagtcaccagtgctacaattgaatgatgcagacaaaaattcctgcccccataaaacttacacatgggtagaggaaagagattaatcaagagaaatacataaaatacagggtgtattatatagtaataagtgaaagaaataagccttgccacaatgagtgccagatgccacttaagaaagttcattgagatggcgacttgtggggaaagactttgagaaagtaagggagtgagtcttgcatatagtacccggaagagcattccaggcacaggaagcagttcgtgcaaaggcttcctggtgtgttgaggaaagcggcctgccagatatgtttgatgaacacatgcctcctttgtttgtggaacagcaaagaagccaccgtggctgtagaagaataagtaaaggggaggggtgggcactgaggtcagagaagtaagaggtcatgtcagtaaggggtcataaattcgaaatattaaagtaaataccaaaagaaatacctgagttcagtatggtggtatctagagaacagaatagttatatggggaagggacagcagttttgtgttataagcctctcagcactgaagttatgtgcttaaagtctttgagaaaaacaaattatttttctaacacatacaattacgtgcagacaatagtgtggtagaaaatgcactgtagaagtttaagctacaagtgatctctagaagctgggcttgtgggaattcttctcagaacatatggaactttcattgagacttgaaggatggctatcatttggatagatggaaaggaatttaagaatgtcaccacaggactccaaaatacctgggagagaatgtagcacagctcccttatttacctggttatgaggacgagaagatttagaagggaataaaataatttgcaaggtctcatagctggttaccggcacagctaggacaacaacctctgtcttctttctcccccataaatgctctatcccgttaaccacaaaggcttttcttcaaaccttctccactctcctcaaacctttgatctcatcacctgctcccctcaccctctgcagcctatctagcttcttcacagaaaatggaaacatcaggccggaattacctctacttctgaccatcaagtctggattccctctagtcctttcctcctcccgtccttcaacagaagatgtctgtcctgtgtgactgagggttctgatctcacctttccctgtggaaattctggaaattacttatgtggctgctgtttcccaatttcctttatggactgctgttttctagtaaatttgtaattgttgatcttttcagggctataattgggcctctttgtttgtgtgttgttcatatgtcctatgggcaagttcacccgtaaacatagccttctcctcttcatgctgattaactcctaagttcacagcatctgttcctttttctttcagacttgtgacctacaacctatcagatatctgcacttgaataattcatgagcacctcaaatgagtctaatgaaattatcagttcacctgattctcctcctttgttccttatgatcacttattacttagttccttagtactatctacctaatggctaaagtcagaaacctgaaaatcatctgagattttttttttcctcatgcttccatccattcaaccagcaagcccagtccattcgacttcccaaacatctccaactgttgccactaccacttatattaccattaaactaattcagacttctctctttttgcctggatcacagctgtaacctcctaacagggccctcaaccttcttctttttttttttttttttaaccttttctttatcagatgagggtaaggttagtgaaatggaagccactctttttatgcaaggtataaggggtttaatgtatgaaatagtgctccgtaattgttggaggaactggaagagcaaaggataaggaagctgacattgaagaccaaggaatctgatgcctaaagacagcctgaggcacttaagttggtggctcttagtagctcaccaggaagctgctgcgaatgtcacattttcctgtggtttttactgcaactgcttccagagaataattgttttgccttcttttctaccttcaaaatcctggataactgcctctcattagtgaactataaggtaaataacataatattctgggaaatgtagtcctgtcttctgtgatggagaaaagaactcagaagggggtgcagtgaaacagaatagtcaacagaaaatccatctgacccctaaattctatttttctgaagtgcagtcagatctttctataaaaataggtgatcatatcattctgcttaaaaaccttcaacagttcatcattccttttaggataaaaagagatactttaatatcactcacaaaactcttacataatcttgccccagattatttctcttactgatttctacttcttagttatctttaaaacctcccaagctagttttaaatgaatgtctgaatgaagaatcctaaatggaaaaagttattacattattggttagaggtgatcaagtttggccagagagggacaatcttttgaataacatttaaaactaaaccaataaatttggacttgacgtgatgggaaataggtcattgagtaaaaggatgacttttaatgaaagaaatatctttaagtaatttggtcttggatattacagagtagaaatcaaaagacatataactagggctttaatagagtaaaaatgatgtgttattactcttgtgttattacattcctaagatgagggaaacctcctcataatccttttgatagaattaactggccttgatagcaaaatacatggagaggaggaaattgacaggtttctgatttgcgaagatgctaatatgactgacttaaggaattctaaattggggagaaacgatagatactacagatttgaggggatgctgcaaacagattcagttattcagctaagtaatgcccaaaagttagctgctaattatgtgaaaaccatccagttgatctgaattacccatataattgtgtcacttcatactctcactttgcccacgtaaaagagcctcagaactgaaaatgcttgattttactctttgccaattccaaagcatcttgttaaacagaaaacattccccagcacagcagagtttaagctcagtgctctctctccttttatggaatgtgcactcttaactactggtgctgtcaaaagctaaagagaaagtcacctggatttgtgtgacaggacttccttttttgaactttctttttcatcttccagagagaatccacaaaatcatttgaaatagaatcaacagttcaaaataaaaggtggaagcttaggaaaattggcttcttaattgacagataatttatttaaaaaaaacacaaatgctaattaagtttacagcaatattaaaaaggaatgttcagaagggataaaattctttataatatttgttaataatattgaattagcatattaaaaataacagaatcattcttctacatccttccaggatttggcgtcattatcattcagtacttcaaagagacataagtcattttcttgccatacaaccaccagtgtatgagggggaggaaacactaatgtctgccctcatcagagaataaacatctacctggacttcctagggaaatcagagacggggagagggcaaaggaactaattctgtcttaccgattgtttatgtgtggcttcctggactaattgaaagggggtaaagccagaatgtgcttagggcaccagtgaacagagtctctccaaccatggagcagtgttcactctctctgcatggcttggggagaaaccagcggagatgcccccttgcattaatgtggttatatctttgttcaagtcagatgtttgctttaacttagagagtcagcttaggagaagggttcatacccgtaatgacgccctccttcttcctgagatgccagtagggccactaatgattgaaaacacacacaaaatcctttcacattgatcattaaggagagaacgatattttaaaatatggtagctaaactgatagccttttattattatttaagtgccactattaagttgttatatgacccatttctttgcatgacttttaaccgtattgacctttgggttgccatgccatctacactccctacagaaaaataacttaggacttagaaacatatgataaatatggtggtgtaaatccatagatctgtattctttacagaacataaataataaatttccccttataaacaacagtggagtttggattggtgatatagcctgtgggctcgccaatcccagcagtaagcacattgacattggcagaaatgttttttaaaaagttttgtgaatgtccctgaagtacaggtggatctttaccaaatttctggaaacctattcttaaataggcataacagtcttttaatgaaacaaaaatatactctttagtcaataaagcaatcaaagacttgtttattgcaatgtagttataaacggtgtgactgacttaatgtcacttttgaaaataaaggctttaaaacaccaagctaataccaatgcatgaccatcactacatgttttcaatatatactgttatataaaattgtttatttcctgtttcctaatacagagcctaacatggttagtaggcaactggaatgaaatataatagaagtcagtgtgctggagtagatcgtgcctggactaggcatctaaagacctggattcaagtcctggctccgccacttcatggtgtatagcagatgtgctctcaatgccctgcccatacctcctcactcttactacatcaatgtacaaggccccgccttccatctgccagcatctgtaccggtacctttggagagaatttgaacgcattcttgtgctactggagctgaccccactgccagtgcagcaggctggaagttctgaggtggtattgcctcctgggagcagccctcaaacaatggtatacaaactccagctccatcactttgagggggataactctgaggcaccagttctacattggctcccagagtttctccaatagaattaaattcaaaccctcacaattgcagctgccttgattgtgtaccctgaattggctttctgcccttccttgtctcactttttgacacacagttgcctacggtggaactcaagacctagttattggacctaggaaggtcatgcaaccactcagtatctcatgtcgtaaatgacaaaatttaacaaagcttcttccaattataaaattctcagatttttattatcctccctgcttcttatctggactttgagagaagtatctgaaatttataacgaaagactatttactgacaatggtgaccaatttgtgattgtcttaacacctttccaaactgcagaaaacaggggagagtctccgcttagacagtggagatgctcaaaagggatagcaatgggaagtcacagatgatgatctttcccagcatatagtcccagtgtttagtttctgcattgtttgaaagcaaaattaaaccttaacaaaaacaattcatcactctgtatatatcataaaaagccattaagagactgtttttagaaaatatgataaatatagtccctctatgacaactcatacttgacaacatgtatactttatatccttatcctttagttagtgtcatccttgcagcattcctgtgaggtagggagggcaaagatgagtaactcagttgtcagataagaaaactgaagcttaaaaatgtttagtgaccattcaggagctgaagccttttgtttctgtgatctgtacattttctgccacattctatttcttcatgttacccgacagttttattatatactaaaagtgtctctattctctttggcagattttctttttaggattcctgttttgtgggatgtagtaataataacatttgaaatctattttatgggaaagatcatttcccacttggaagacgagctggaaatgaatgttccagtgcaaattgtttttggtacttgttggcactttattatattaagtgtgttcttatccacagtatctcatagcattactatttagacatactatgcctaatattggacaacatactcagagaaagatgtaataaatgagatttcagggattcaaagaagaatcctatttacctccttcacctgtcctacctgctagtggatttctgaaatgttccaccactttagctgaacagtttgatccctgctaaaataaaaatatccttgatatgtgtcacagtggaatctgtttccagtcattttcactatgaataattttaagtccatttctgaaaacagatttgatagaggaaagggaagaaccacataaggacaaaaggtagaggaacaatggggatgggggtggggatggagaccaaaaagaacatggaacagcatactggcatatctgacttcacaatctgcctgagtcctagacagacactcacagaataaatgtactggccatgttgtcatgggaaagtcatttacttttgtgaatcaaagttttctcatttgtaaatgatgggttaggactacatgatatgcatgttctttcagctctaggattctattctttgataccatttatcacatactctcatggacatggtaacaaagatgaatgataaaatccagttggcttctgttttcctgcatattagctaagaatcaaaaaatggtagcgagattttgtgtttgagcatgtaatccacaaaagagtctccaaaatgagaaatgagcaaaggcaaactagagagctaacagtatgcattattcacaaatagtcttgtgtacgtgcttataatgggccaccagcaatttgacaaggtacagaaaactgaagggtatatctggtatgctgtgcctgatttttcagccagttttaacttagaggcaagtaaagggctgtatgagatacctaaccagaaggaagcaatatgttgcttactatcactcatcattcactcaccgctttctattttccatgtgccaagtgctgtgatcagtgcttgggttttcccagacatgaggcctgaaacaaggattgaagtgctagtgatttctggaagtttcagggagtgttggtagaggagtaggcacgtggtacaggaaagggatggcagctggtaaaaggtacattatgaaaccagctaccactgcatgtgactagagcttaatcctgcaaagaaactcagggaaaccataaaacatatgcatcagatttatcctattgaagggtcaagggagatggggtatttattccacagctcccactagttactaactataagctactcttgtgagatggtaattctccagcacttctggcctccacgtggcaggcaaggtaagcactgatgggcagacaaagcatagctcttcagcaaaaaacgcaggtaagaagtaagtaagagtagccttcactgaagcaataaaggtgaggggatgtgggtaggataccaacaacattgctacacaagaatcctctcaatacatccttaccaccatcctacgagacaggtactatcactccatcatacacatcagaagactgagcttcagaggctgtaagtgccttgtaattgtaagatgtagagctgagattgaaatcaaatatgtgacaaaaaacatatcattagacccttctgtatggtgcaaaaaggagaaaatatgtcatctatgtcattacttgacccaaatgctcctccttctgtgaagtactctttgattttgtcatcattcttcctgtgttaccatagacctttcttagttctgtaagaacagttatcacagctctctgtaattaactgtttcaatttactctccttactaaacaggcgtttcttggggagacaaataacattgatttattcatttttatattcccttgtacgcaaagaattggcatatagaagaccctcaattaatgctgataaaatgcctatgccagatttttttcatagaggctcaaattgacggtaatttgcccattcaaggcagccaatattgatagaatccctactatgtgttaaggaagaaatagacacagaaatgaaagaaaataaatattgctgaaatgcagagttatatgtgtaaaacttgtttgtctcttttccaaatatatctactcagtcaactcaggtttgattaaatttttgtaggtcttcccaatgtcaagaaaaagcagcctttttaatctcattttacccatgtgtgataaacgccaagaaacatgtaaatgctgaagtctatttaatttgttttatacaagctggggctgtgtatgaatacctggtcctaagattctacgttttatgacctattcaaatatgcgctaatggtgtcggaatgaacctattcaaatatacactaaaattctgtttgcaaactggggcccaggcttcttttggctgctgatatacctcactgagtatagggcaggagggcagtaattttctacatatttctactgcacagcaagacgtagttaatttccaggtgcatattgctttaatttcagttagtccaataatttttggaatacagtgccagggtcctctctgccagaggctataattttataagagcagaactcatgaaagtgtgtgggagagattagtgggcgggcctgaaacgctttctttctcactttgtactgtgcaaagcctcaggcagaaggtttaggaagtagtttcatatggagacattgatcgaatttggatgaactctggagaaaactcagattttccttgaagtttagtcattggaatcaggaagggaatctcatgtgcgggagatgatgtgtgaagaacattcaggccccacgttgtacttctcttgtactgctctcttgtacttccttctttttcaaaggaatattgattcttaatttgattggggttaaaaatgaagagtaagtttattccacgccagtcagaacctctcacagaacacgtcagaagtagcgaaccagtgataatccttggaaatttttttaaaaagccaaatgcatgcacagaggacaaagtgcccaggactggcccagaaccctaagggatttatgtaactggctgcaatggcacagtggcaaatgccagcaggaggccagtcagcgtgtcatgatacacactgaaattgtaagtgggctgtcagagatcatagcatatttatgctgtgtggtttatagaaaaggacacatcccaaatacagactgacccagagtccaagttatcaagttggaaatgtatatctcatttgtctcatcttttttggcagggagattgccagggagaccgtgaaaagacaccgtgaaaaacatttccatgtcacaagtactcatccagcaattatgtggtgcccacaatgtgatatttcagtgttttcactgattaaaactcacggtcaaacccattagagagtcataaaatcaatttcgtgtgtagcaactggatttttaatgaaatatagaatagaatagaatgaaagagaataaagtacagcagattgcatcttatacaggaaaggtattattttataaagctttgaaaaatgtgtgtttatatatgtgaatatatgtttatatattcatttatatgtagatacagatacatatttgttatatgcatgagattgacaagtgggccaagacatggtagaaatgcatttttcttactatggattactattaagataggatctaccacaatggcttttaaactaacacaaatacaagtaaatgtaacccacacataaatccctgctcttcagaatattacaatctagttagaaataaggcacatgaaggaaaaggaaacaactatttgttttattcatcacttaccaaaatcaaggtgcataagttatcccatcttgttctcttgaaaatcttagatacaggagttactgttatcatcttatagaagaaatgaaataatttgatcaaggcaaggcaacccagcccaaataggtagagcctacagcctggtctaatggttaacatcacaatttcctctgtatcttaccaccttcctgaaaaggtggcaaacgtgtatgaaatgggtaatgtgaacaggaagaaacttggaaattttaaggagatagaggatattatgaaccgtcaagacgagggagggggaggtttcatggaccaggtaggatttgattttaactggagtcaggaggaaagaaaacagaaatgaattccaaacagtggataggagataaacaaagtcttagagtagggaataagcatggaatgcttagggcccagggaagtagactgatctgatacaggggaagatacatgtttggagaatgaagggagaaaaggctggacacaaattgtccctgtgtgagaatgatcacgtaccatgtgccaggcactgtcctaagagctttttatacattatttaattctcatgacaagtcctggcagtagatattacagtgctctttgtaaagaggactaaatgagacttaaggagttccataaattgtccaagatgttgttatggtactgggattcaaagacacacatgtctgagtctaaagcctaagctgctagtcactctgccatacctcattctgtggaggacactggaaatgattcacagataaagcttatgatatagcctccccacccccaacaatactacacagccccagcaatgtcattcccatgaagttgtgttgtggcaacacttgcatgattatacatgtggggaccctctttagtcgaatggtggaaataggaaagggaggtgaggaataaacgaatgtgacatattgaagaaagaactgatgcaaaaaaaaaaaaaaaaagcagagcaaaggaattgccagaggtcatgtggaagttccaagcctgagtaaatcagatgataacattggtgagatggagaaattaagccttgcattgaaattatggtcatactgaaagaatgccatctacatgccttttaagataactgtaaagtaaccatatttgttgtgtgcttacaacatgccaggcatggcaccaagcatgttgtgtgaattagtgcacacaataactcagatgaggaaactgaggagtgggatagctcagcaacttgcccaagatcacacagcctgtaaaggtcagagccaggtttcaaactgaaatgcttaactccaacccagacttctcttctaaactccagcctgtatccatcaaccttcttaacatctctacttgaattatgttaagtatctcaaacttcacatgtccaaatagaactcctgatctcccactacctgccccagcctcaccagaactgtacttcccacatttttcccatcttacataatggtaagtgcatccttctagttactcagaccaaaaaccttggaattgtccttgactcttttcttttgcttgcactcaatggaaacatcaacacatcctgtctgatgttccttcaaaccatatgcagaatctgttacttctcaccacctccctgagcaaaacactgcatctcgtacctaatgcagttgcttcctaactagactccccaagccttcccttgcccctctttgtctactctcaaactagaagccagagtgatccttctgaaacatagatgaagtaactcttctgctcaaaaccttccaatgacttcccatctcagagtaaaagccaaagtctctggaatggccttcatggtcctataaaacctctaaccctcaaccctatggtcttatctcccacttgtcctttctcactcagctccagctacgtgagactcttcacggttccagaaatgttacggatgcctgccttggagcctttgcaattgctgttcctctgcttggaatccctttttcagtatgtgcacagggcttaatctttcattaccttcaggtccctactcaaacatccccttctcggtgggaccttgccagaccacctatctaaaattacagaagtgaattttgctattcctcattgctactttgtgtttgtccttagctcatactgttcctcaacacactatgcattttacttatctcattattattgtctccatcaatggaatgtaagcccaatgagggcaggggttttctggcctcttttgttcccatccacagtacctataacagcacccaacatatgttaggcacccaacagacatttgctgaatgaatagataaaaccgaagcaatctgattccagagacaacactcttagcccctaagctgaactaccacctctcagaagttgaagaatgtttcttgaatagagaagttctgaatgtttttacccaatattaattatttgtcaagtctagcgagggtttaactgtttctaggtaatcaatgcagcaaaactataccatctataatatggtacatgtttttgtttggtaagtaaaatgtccccttcggggttgttaataaatgggctgttatctggtttgtcttattactgcaaatttctcaagatggttttatttctctacatgcagtaaatgtactgccagagagtatatgcataatagttaagataaacatagagtattttaattagaacatatactttactttttatttcatgatttttgtattaagtgtttcatagagttccttattaactccctgttagcctccttttacatttaaagaaatagactgaagttactttggattttctaccatggttctggcatgaggaatgtacttaatgatgagtaagaagagtttattcaattcctatctttaaaaaacctatttctcaagtatctaaaattatgaaatactctatcgtattaagttttctggaattctttaatgtgtgttaaaaactccactcccttggtgctcatccataatgtggggttttcttttcacttccaacgtcctgcccagtttggaaaacttgcactaacattggaagtttatttgtatttagtacatcttaaaaagtgcccctatatgtaaaatctacagttgcatttaaacctgggttcctttttccacataacaagataaagcatgaataaaactatgtccttattaagtacttttttagaaggataagttttatccttctaaacatgttcattaaatattagcccagggcaaatttattaatctaagcccttacacagggaagcaacaaactttttaaaatacttaaccaatctgttagtaaaatggttcaaatgcctccttttcagttcctctatatgtaaaatggttgatttaattgcatttgatcattccaagtttcttgataaatgtcgactcacgttctggcttaggttaaaccagtgttccccaagtgttaattgctgacgttcagggggaaaaagaaaatctctttccatggtcacatgaattctggaaatgctcagttagactgagagcaaagtttaacatgtttcttattgtggaactcttcagaacctttaatagtatgaattgtgaatcccaagaggaaggataaaatttacagggatttttcaaactgctttcaccgtggaaaatactttctatgagctacctagctatagtaatgttccttaaaacacaatgtgggaaacattgggttaaagccccagcaagaagtaggatcatttaatcatcaggagagtatctgcatagagtttaaaatgcttgttgttcagagacattaaaatttctgttatgtgtgttactgataatactttcaacttgcaattttaaatatttgactctctgtgggagggaagggtgacctagccatgataaaatgagagagaacacagagcaattacaaagcatttttccattctgattactcttttttaaacaacttctgatgtctgtgcattttgtctctgtgagataaagattctgaattccggtgaggcagatcacaaaggtgatgtatttttaatgaaatcttcaggtaggaaatgttcaatccacttcttaagattagttgccctattaccagggtgaccatatgtcatggtatgtccagtataatccagatttttacttgttatctctgtgtaattactagcacctccttttagtctaaaaaacagtactattttggataacaaagtatcctgtcactattccaattacacatgtgtggcagattatatttttcaaggaggttgcagcagtatctatctcctgtccacatgccactctcccatcaataaaaggggtctaatttctctcctggaatccagaagggcctgtggcatactcgtaaccaacagaatacaacacaagggacactgcctgacgtcccagctgaagacataaaaagcaattctgctgcagtctcactcaaaccctgcgttggagcccttagtcaccatgtgagcagtctgactgccctaaagcagagtcatactgtgagaaaacccaagctaacccatgtggagagatcacggggagaagccctgagattacaaggagagagagatgcccagctagctcccagattctctagctctagtcatcatctgactgcaaccacatgagagatcctgagccagaagtgtccagccacaggcttcctggaatcctaatctgcagaaatcattaaataacaaaatgattgttgccatttaaagccactgttagggggtgatttgatttgcaacgaaagagaaatggaacactgtggaatttggatcagacataaagttagagtgctaggggtccgcttaccttgttttgaatttgaaattaggccgcagatatttaattaactttctgaaattcaagttaaactggagactacatagaaatgttacgtccaagtacccccatccaaatatgaatttgcaaaataacataatttggtaaaatataaaagtaccaaagaacaagtctattgcctttcttcaagctctaattatacctcttgtttgtttttattatgtatagaagagagaatataaaacatacctatttagcttaaatactgacagcaagatgaatatatgtgtacttttgccacccaactataaaaatggagcacgactagagccttggaagtgcccaccccaagtttctttctgaattgcccccttcttctctttcccagaggtaaacactatgccacaatttgaaaattttttcccttaattctctgtgtagttttccagctcacatacttttcctgagacaatctatttaatttttctaggtttttaacatgaaagcatgcagttattttttgccacttagttcttttgcctaaatgtatgttttctagatgtatccaggttaatgtatgtagctgtggttctctccctcactttttacatagctcttatttcagttaactaaatcgatggggaaaatgagacatgctcacttgcttcagaagtttctacagagtaaaatgaatgaaagacaaaagcaagaaaatacaaaactgatttgaaaccctttacaattcatacatagaggaaaaaatcatctgttcatctctcagttctgaagtactcaagtcaaaccactttgccatctgagacaagttcgtatggtgtctagctgagaaagcagcctaatatttgcatcgtgttaacccagcagtaataaatttcttaacacactttcatcctctcctcactatgatcatcctagtgacataggcttcctagatgttcacccatactacttcttcctcttgggttcacagttatatattggtgccatgtgactgattctggcaagtggagagttagcagaagtggtatatccctatccaaggcctcaccgtgcttacccctccataaaaattcatgctttctattccccacaaggtgagaaactcagagatggccatattataggttgcaagaagcctggatcccacagttgcactaggagatctgtcaaggagagtcaattgtccaactgacactgggctatgaaaaactgagattttagaattctttgttgcagcagcataacattgccttgtccagtcattattatgaataaatgttgtagaacacaatgatgagctagaggacattaaggttttttttgttttctggtggttttttttttttttttttttttttttgacagtcacgctctgtcacccaggctggctcactgcaacctctgccttccaggttcaagcaattctcctgtctcagcctcctgaatagctgggattacagtcaccggccaccacgcccagctaattttttgtatttttagtatagatggggtttcgccatgttggccaggctggtctcgaactcctgacctcaagtcatccgcccacctcagcctcccaaagtgctgagattacaggcatgagccaccacactcagcctctgtttttaaattctgctttcacagaggcccagcagttttggtgaggttggaagagagtgtaagataaaattctattaaaaaatagcaaataccattgattgaaccctcatcatttgcctggcaatgtgccacacaatttataagcaatatttacttggttactcatagcaacctatgaaagaggtactattttaatcatcagcattccatttatgaggagcctgaaggctagatatgggaagaaacttaaggttgtagagcaggtgaattccagggtcacaacttgaactcaggtccttttttctcccaatttcatgctatgaacaaggatacttaactttaaagtttccagggacagattagtttagtaaaatgtaattccaactggaggcggtgattggaaagattccagtgtttccctgccatagtttccacatttttgatactctcactctgccacagcgagtgggcttactgagggagtgtgggatgggaaatatccctaactatggctacttgcctgcggatgcctcattattgtcactgccaggaaagcaaactcgaaagggagaagaggcagagaagtctaagaacaggctctgtgatgtgcatcaaatagcccttgggctcctccggagctgctggcaacccaaagatatattgagttgcttgtgtctgtgttgagtttgaaagtccagtgttattttacagatgatgatttgaaatgcccgaaaagtatgtcagggcaccatggctgtttaggtattccaaattgtatgtggagcttgatatgcgattgtcgcttaagagagtttgcaagtgacatatttattagacattgatgaatctcaaaatttggagaggttcagataagcatcctgagaatcagaaactcatcagttgcgcttctgacatgttaagggttttcttttttagtttagaagcaagttactttcatgatgccttatgagtgtgaaaaatttgtgtaaggaaactgcttttcattagctagaggaaggcaggactctatagtctgtgtagaaaataaggaaccttttaggataagataatgcagtgaaaagaagcacaacagaaaagaggtgaaatggagttggaaagagataagaaaaaatcatatatagaagcagaggggaagaattacatccagaatgggaggaagacataaaggaagaatatttttttgaaaggagtgtgcttaaccattgacagtttccatgaagaaatatcatgagggacggattaagaacattctacattgaagaaggcttaaggaaagatagtcaatctgtaaatgtttttcttactagaggaaaaggtaaatattaataattcaaaacaatagctgacatcattcactttgtacttatccttgggatgaaattagaggccaccgcctcttatacatataaacacaaacacatacattttgtgctccctactagtttttgccaactgtaggcaagcggtacacatggaggaatccaccctcactcacatcccatatcaacacagataaaccacttaagaaggatggaattaatatggttgcctcataatcctcagtaagctataaaggttgttttttatttcctttttgaaaagaagatgatataatatgcctatggtatcaggataatgttccctgtcagcagagggagaagggagagaagagataaaagaggaagtccctttaatctgaattgctttgtggctggaaattcacaagtatagcctggaaggtctggacagctattgcactgctgctcacatggtgctgataagcaacgcagtttatttccattatttcacgataactataaggtggccacccacaggcatgggtgaatggagcaggaagaggagagggagcagaaagcctcagagaatatctcctctcatagtctggctgtaccaactctttatttttgttcttattcccagccctatccccgcctgcctcttcacccaccttagtgcacaagtgcaagagttaatagtaaagccatgactaggaaaatggaatgatgcacttatagcagcaactgagtttaattccaaagtctgcccatagattgatgtcacgtatctggctcagctctaagcacatagttagcatacacaaaatgttagttttcttcccttttaatcacccctgttccttctcatctttagttttccggattgatttatttggggttggcatctgggagtaggttgactagatgtctttatggtcttctgtctcagcaaagactatagacaccaaaagtttgaaaatcccaatccatgaaatgtgcgataattcataaaaaataaaattagtaatttgggcctctgctcttcttaacgtttgaaaaaataataaataataactcttttctctttcctaacttgtttctagtaaaagaattttgttactgagatattttgtctcaaagttattatcttgtatttttctagaaacaaattgatattaacagaaacaaaaacaatgaattttgtacatcgagagccagccagtggtcagtaactgaagtaatttacatatattacctcatttgatccttacaacaaccttcaaagtggttatttttatcactaacttataactttctgattttaattaaattaactgaacaagaaccctggtaaattatcagaaaaaattgctaaatatgttgctaaaccctactaggacttccattaatctttactgaaaagcaaattcaagattgcaatgttgctttaataagcatgagctaaccataatacagctgagctggaaaatgtggatgactcactttacaatcacccccctttgcctgcctgtagctaacactatcaagcacttccttatgttagcatttaaactcatccaaataaattaattgatggaaagatattggagattatgtaattacttcctctggctctggtggtgttgccatctgacttgcaggcagcaagatgagatctaaattaaatgcaaataattgttcacaattagaaaatgaaatgcctggagaaccccatgatattttaaacaagctgatgtacttgccattgatcaacagttgaggctttctagcatgtacttggcttgagtcccgatgatgacattgtgcatagcaacaagatgcccttctacatgatgagacaagaattcccaaggattcatccttcggtaagaagtgaacttttaggaaggtgtatgcatgaaaagtattcttagttcaaatttctgagggttactgggtagctgatttcaggtcatacagggacttgcaaaataaaagtacctaaatatttaagttaggcatcttggatagattagatatatctaaccttcactcagggcagttaaatgggtgagttttgtattgctttgatttaatttccagctcccccaccccccaaaaaagccattcttttctttttcaagatgtttctcaggatctttgaggatgacgttgatatgaagtgatccatccatacctataatgatgacatctaacaaaaaaaaaagacttcattgcctttgaatatgctaaaaaagatgctatcttttcaatagagacaagggcagaatgatgaaggaaagacatagcctgaaataagaaaatgaaaatgcccttaagaggctaacagcttagatggatacaaaggtttttataaaacaccattagtattcatttagtataggtagcagacagcaacaagaattggaaaataacttggatgtgatcactgaagggacagagggaggcaaaaaatataagctgctttctgagcacaaatctctgtcactggagagcacagttggaatgtcctcctttcctgattagcaaccatctaatcaaggacaccgagtgcctgccaggtctatatacatgtcacacagagaagaaacagaagggttcaggccgagatgttttctacctattatatgcaccaggttaagaacaattttaaaaataattttttgtcataaatttaatgggatgaagtgagggtagtttttttttttttttttttaatgaagacaaagtctttccagaaatctttactaaagaaatccaaaacctcaacatttgtctatatatagctaaggtaagagggcatatgaataaagcagagaaaatccagaatacatatatacaagtataactatggatttaaatggaacagttgtctaaagaaagtcttctcagcctggagaggcagaaactacattatacaaaggccttcaagtagaatatttggtaagatttgctcacaatgttactacattatggctaagtctttaaactgcaatactaacctctttgattgcagtgtgaaatgtcactgctcaagtcccccacccctggtgggtatgtaactggggtcatagggtaaatgtgttttctccctattgtcatattacacaggaaagcatattagtataatcagaatgctttgtgagtaaggaaccagagcaggaggagaagttactcaaagatttcttataccagcatcagatggtccaaaatagggatatacctgccagatgcgcaagagtgtagcatctgcttgcctgggcatcctctctgttgttcggcatttggaaaagcttgaatattgctggcttttcagtgtctcctttttctccttgtattcccagtgcctgcctagcataccccaaggctcaaagataatctcaactgtgattgaagagtaaatgaattaatgaatgaccttcttgtccgatggatacttttttcttcatatttctttgagacaatcttgttctgaccaaaaaacaatagtctgtgccttaaagtgactttgcgtatctctgttctaatcctgtctgtgtttttgcgtgtgatactcaagctgaattctgagctaagtaattcacatttgagagaaaaacgggatggaaagtctggtaggcattatagtacacaagaaaatgtctactatgcaaaataaagaaaagaacactcaaggaggctgtcatgcttctcagaatatctttgggtttattgatacatttcttgatctttacaagctcaccctttatgtagttccttctccagtttgcaaaaatttattaaaatgacagcagtcttggaatgatcttggactttcaaagatcacaggatggtttttatgtatagtcatgacttcctcaagtcaacttttaaatatgttaaggtctgcacttaacaggaaagaaatgtagacttctgttcaacctaaaaggatcacataagaattaggacttactttgcaaactcactttgcaaaatgaatttgattccccagcagctctcaaccaactgcactttcaacttacatctcgatgtaagacacttgaaaaattgtgatgccttttgaggtcataatgcagtgttggaaacagaactgcattgtggaagaagccatgatgttcaggcgctttcattcttaaaccctctatttcttaatggtcactctatttaatgatgtttcttaaaagattcgtggatgtttactgatacccaacagggaaattgttgagggctttttattctctcctttaattcaaaaatacttatttaaaaggcagcagacacacatgatagcaatgatagctaaaagcgccctgaaggagataaatttgtgttgaatgctacttgcttgtcttttgtaagattcataagagtacatttcaaactctttacaaggatacagttgaggtattgattattttaaagcctggacaagaaatggtgattagagtattgagaaccctaaactagtgatggactatttccatgtatctctaatatccaaccaaaccaatacttcaagatttcttatgtctcaatgatttatgcattatttatatcattcttttctgagtttctgttggctcttcattaaaataaaacataaccatagattattttcttatacgggcacgtatactatgttttgcatgtataagaaataacatacaacaaacataaacacatccaaagatctttgatacttggcattaaatgttatcccttacaaatatctccctaaagggctctttgtcagttttgaaaagggaggcaaaacaatttcaagcagctatgtaaatatgtcaagtaaaaatgaagttaatatttattttagaggcatttaccctatttaggtgcacaaacatttgaccatttttagtcttccttcaaattgaatgacttccaaagaccacagaaatattattatggggaatgttgtcagtggatatgtctcaaaatgaaaaagggtattggaagggcattttaattcttgagcaaatgcagagaaactttcaaataatctaaagaagaagaaaaatcatccctgaacataaatcagttaggaaaaattcattcgaattccatcactgggtgatactttaatggatctcagagagaagcaaaacacagtaattaaagatgaaaagaaaggcaaattaaagaatgccaataatattagtgtggaaatgggtaccttggatgaagcaaggcaagaatttaaataaattattttgtaatagacccatctgtctgctctgcaaaactgcactataatctggcacaaatttttgtatgttgggctgagaagaagctaagaaattgaaatttttctcgtgagcagtaggtaaacactctttgttctcatttgtcttgaattacaactgatcatgatggcttgagcatctcagtgagtaattttccaagtccaggctgccaaattccaaaggacaatacttgtgatacatccactcatttgcatcctttcatgactcaaaaccaatcatctgtagtcggttatcctaatgagtcgagagtctcaaattcaatcattattacaggtgatgtatgtagccttacagaatgtacgaaacatttgcttggtgcagataaactagcatcatcttatgtattcagatttataggaattacctgctctactagtgcttctccttaccaccgtttagtcaaccacagtcatagagcacctatatcaggctcagctgtacccaaggcacaagggccacaaagatgaaaagacaggtttgccaccctcaagaaactgcctacatagtgataaagatggacatacaaacacattacaacacagtattaactggtagtaaaataaaggtagatataacagcctatgaatacaaggaggagttctaaagaaagctcctcaaagagaatgatgtgctaaatttgttttaggtctctaatatgacaataataatgacagcaatagctgcaatttattgagtgcctcatacattttagacacagtggtaagcagctagcttgattaatttcatttcatccttttaatgaccccaggagatagtattattttcttcatttacataggagaaaacttgagcatggagaatttaggtaagattcccactgtcgcacagctaatgagtggagccaaggctcgagtcaaaatctgtcaattgtcaagctgctctgttcttacaatatttttaactttttattttgatataattttgaagaactgcaagaatagtataaagaatttccatatgtcctaatctaggttcttcaattgttaatatttttatcatatttgctgtatcaatattcctctcaatagatagatagatagaagatggatacatctataattttgtaactacatctataatttttcttctaaatcagttgagagtaagtttccagcgtgatgccccattatctctaaatacttcagggtttatttctaggaagacaaggatattctctcatatgcttgcactataattaccaaaatcagaaacttaacaaagattatgtacacacacacacacacacacacacacacacacacatatatatacttgtatgtatgtatttttttcttctaggagtcaataaatcaaggatcgtgtgtttcttttaggtgtcatgtctctttggtctcctttactctggaagagttcctcagttcttctctttcatgacattgacatttttaaagaacacagaccagttattttgatgcctattttttcaaatgggagcagtctgatgtttcctcatgattagattcagcttgtgcatttattggtaggaataccacagaagggagtttgtgtactccagagcctcatatcaggaggctgtcgtgtcagtttgtttcattactggtaacattaactttgatcatttagtggaggtggtgtccaccaggtttctccactgtaaagttactatttttccttttataattaataagtgttttgtggagggcataaataccctattcccacagcaaacgttcacccactagttttagcataatgactgttgactgaattaattattggttatgatatttaccaaatgataatttcctaattccatcatttcttctgcattcattcattggaattctactgtaacaaagagccttcccttctcccatttttttctatatcatttattcatatttgtatgaactcatgagtttgtattcagtgagttataatttgttactatcgttatttactttgctgctccaattgtcctaaatttgggcagagtatccccttcaagcttattcctgtgttctatgaacatgtctcaatcattctttgaggctactttctggcaccaccaaattttccaggttcacttggactttccctgccccatccctggaatcaaccatttttacaaagtaagtctttgttcttcactgcttcccttttgtttgtttttgtttttgtttttgagacagagtctcactctgtcacccaggctggagtgcagcggtgtgatctcggctcactgcaacctccgcctcccaggttcaagcaattctcttgcttcagtctcccaagtacctgggattactggaaagcgccaccacgcccagctaattttgtatttttagtagagatgggatttcaccatgttggccaggctggtctcgaactactgacctcaggtgatccgtctacctcagcctcccaaggtgctgggattacaagcttaactgcttctctttttgaccactcaccggttttttgtttttatacatggataacacaggtgttttaatatccagaaatatctattaaagagtcattttcacaactactacaattataataaaagctgcaccaagctagttcggagtcagtgtataagtcctcaaatgcctttcaaatcctcaaataaaggatgacttgagtcctaggaaagataaaaggaaatatgaagaaaaggagagcaagaaaaggaaaagaaagataaaatatatacaagaaaagtaataaaaacaatttgttagtaccttctctgggtcaggcactgagataaatactttcacatgtaacctctcactatattcctgcaacagcttcttggaaaagaaattatgatcctcacttaatagataagaaaatagaggttcagatatttctatgactttacctaacctacacagtaggtaagaaaactaggaattgaatctatccgtgtcatattctaaaccaatcttgtacctggtgctgcctttatacaattttaatgctaattcatgtcctatatcctatttttgtagtcctatatcctatttttgtaattggccagccctctacaacttacatagtagctctttatttacccatttcccaaataccagaacaccttatgctcagacagatgataaagactttccttagctctaagaacaacctgttacagcatacatctttccctgaattaggattcaccacctgctttttaggttggctttatttgctgaactgtgaggcacagtattctagaagcacttgacataccacagacagcctttattcagcaggctattattaatgcctcttgtaataaacactatacctggtgtctccatttcttaagggctataaatgttgggggagaaatgcagttcactcatcagtaggcaatttgagaccataaggaatttccatttctctaacagggcaaaaataaaatgtctgattatatagcaaagcaaggtgatggttatggtgtttactctgtgcatgaatctattacagatcaaaaccaagatgcatccacagatacgtacaagtaagttaaagcagtcaggattcaggcaggctaatgtgaaccttatggtaaaatatgaagaaatactccccaatagagcaactgggaatagctaatagctaatatttgcacattttaaaaagcctattcatgtacatttgcatctcacgtaaccctctgaaggagaatggatgcatcatttcatcttcattttacaaggggaaatattgggatcagagaaatgaagtaacttccccaagatctcacagcgaatcaactggcagttgatactcaaactctgcctagtgctctttatactacactatgattaaacttcttccaattagatttttgctagaacctcactaggcttaatcaaatcaatgtgagcagatgggaagtaaaggaaatccattcccactttattccttgaagcctgttaataaagtacagaagaagcaacatggggctctttcttctatccttttagtcaaaattatgttttgtcctttagtaggtcacgatacgatatatgaaatatattttgaccaaattaatcctactctgtgtcaattagaaacaagatgcattcttgcaactttaccatttattatttttaaattttttttaagttttctggtatatagtaggtgtatatatttgtggtataccttagatgttttgatacaggcatgcaatgtgtaatgatcacaccatggagaatggggtatctatcccctcaagcatttattctttgtgttacaaacaatccaattatactgttctagttattttaaaatgtacaattaaattattgactgtagtcaccctgttgtgctatcaaatggtagattttatatattctttgtaattatttttataaccattaaccatccccacctccccccaaccctcaacccccgactagaggtttcccagcctctgataaccatccttccactccatgggttcacttgttttgatgtttggataccacaaataagtgacaacatgcggtgtttgtctttctctgcctgacttatttcacttaacataatgacctccagttccatccacgtttttgcaaatgacatctatcatttattattaaaacaaatccatagtgacagatatattgttactcctattttttagataagagtcctgaagctcagatgacacagctgataacagggaagccaggacagaatctcattgttttgaacaccaaaacccgttcccttgacaacttggctatactacactattcgaatgttgcagatactgtggtaggtatgagtctaccattgatccccaatcctttctcacaaaggaagtcagggaattacctccaaccaggagggcctggtctctttttccatcattcatttggatgtgctgccgtggtccctctctcctatcttctgcagacttctgagtgcaattaaaacatgaattttccttttgcgggaacctgttagttctcaacatttagtccatataagtatcacctggaggacttgtaaatacactaaattttgggccttatcccccagagattctgatttaataggtcttgaaggaaggatggagcaggtcttgagacaatgcttttctttcttttgtttattttcaaaccaagttagttctgtcttattgttgaaaatttattcttttttattttaaattcaggagtacatgtgcatgtttgttacatgggtatattaggtgatgatgctgacgtttgggcttctaattatcctgtcacccaattagtgaacactgtatttgataagaagtttttcaaccccctgccctcaatcacttttggaatctctagtgtttattcccatatttgtgtccgtgtgtacccagtgtttaagtcccacctataagtgagaataagcggtatttggctttctgttcctgcattagttcacttagggtaatagcctccggcttcatccatgttgctgcaaagaatattattccattcttttttatggctatgtagtattccaacttatatacataccacaatttccttttccagtccactgttgatgggtacttgggttgattccatgtctttgctattgtgaatagcaatgcaataaacatatgagtgcaagtgtctttttcgtagaacaatttattttcctttgggtatatacccagtaatggcattgctgggacaaatggtagttctatttttagttatctgaaaaatttccatactgttgtccatagaggctgcactaatttgcattcccatcaatagtgtataagcattccctcttctctgcaacctcaccaacatccattattttttgactttttaatagccattctgactggtgtgagatggtatctcattgtggttttgatttgcatttctctgatgattagtgatgttgaacatttttcatgtttgttgtctgcttgtatgtcttcttttgagaactgtctgttcatattctttgcttactttttaatggggttatttgtttctttattgtcaatttgttcaagttccttataggttctggatactagtcctttgtcagatgcatagttagcaaatattttctcccattccgtaggttgtctgcttactctgttgatagtttgttttgctgggcagaagctctttagtttaattagggtccagtgatcaatttttgtttctgttgcatttgattttcataacttggtcataaattacttgtccaggcaaagagatagtgctttctaacagattctcagatgatatttatattacaagtccagaaaccacattttgcaatccactgctttagattgggaggaaaacagaaagtcaatttacctcattccctatctcatagtactcctgttgggaactgaaatcgtttgacaatttttttttttttttttttttttgagacagagtcttgctctttcgcccatgctaaagtgcagtggtgcgatttcggctcactgcaacctctgcctcccggtttcaagcgattctcctgcctcagcctcccaactacaggcacaggctaccacacccagcttatttttgtatttttagtatagatggggtttcatcatgttggccaggctggtcttgaactcctaacctcaggtgatacgcccacctgggcctcccaaagtgctgggattacaggcgtgagccacggcacccagcctgtctgacaattttttaaaaaatcatccatcgtatctcagcaaatttttaggcactgtgtataaaaagataagctattacccatgatttcaaggaggtcataacttgataggagacaggcatgtaaacaaataaatggaatagagtatgacaaggcctatgatggggtaaaacaagatataatcagaggacaaagaagtggtgacttctctccttagaggttacataaaggtacgtaaacagaaggtaacagttaaaaaagagtcttcaatgtaggtacaagaggtacattctaggtgatcggaagtatgttcaaagtcacagaaatatagtatttggggagttagagggaattgataggtttttttgtatggtttaaatgctgaatatgctggttaacagcaagagagatattaaaggaatatgattgaacaaacagtgagattgggtcttgtgtgtaacctaacatacccttttcctagggttgggaaagtaatgttagtgtttccatcagtggagagcattataagacgtgagctttagaaatatcactgtggaaagtggttgggaagatgaaagaacatggtgacaaaggagcacaaagactcttgaacaaaaagagtgatactgtggactgggataccaaatattttaatactgggtatatttctgcctaatttggaaatgcctgtacacattgtattgtaattatttctttatatgtctctcttacacagtagactgtaactcctttgacatctattatcggtacccgtgatagggcctggctttagtaagaattgaagaaatgtggactgaatgaatatataaatgaatgaaacctgtatacaatttattttcctttggacttcaatctcattctatttaaaatgaggagaattcattttattctccccagcatgtaacaaatgaatgaatgaatattaataaagtgatacgtgattattaaggaagcaagtcgaaatgagtagcattctggtgatgggatttatcacacaaatgataaccagttgaaccttcatttatttgaataaaatttctgaaattatctccaaattgctttggtatagatagctggactaaattaaaagtgttactacagaagtcttcaaatgtccattaattcttctgtgcaagtaggttaatttgcagaagatttacctattcctatatgaaaccaaggcactgctggttctgtcagataattttctcaattacatttctaggcaattaaataaattgcagaaaatacacttgatttcttctggaaactcccattctgaagggagtgagatcgtcacccataagagactatgtgtctgtggtctaaaaggaaattttaaataactttaaaaacaactgattttaatcttatgtacttactttcctgatcaattcttttcctaacaccatggtgttttcaaaaccaagacatcttcatgcttccgtggttttacttgttcctcctattgacaatgaaaaagttcaaggatgcaaattctaaataacaaaaagaaataataacatgagaatttggccaggcatggtgactcatgcctgtaattcagcactttgggaggccgagggaggcagatcccttgaggtcaggagttcaagaccagcctctccaacatggtgaaacccctgtctctactaaaagatgttgatataatactatactatcaatttgtgtgattaaccatattaagagttaaaataagaaaacataaatgtcttgacacggtaaaagttgataaaattgaattctgtgttacaaaataaaacattgcaatccttgaataagtcaaaactggtcacaataccaagctcttcgtgcccttggtagctggtcaccataaatttccatcccttggtgacctcagacagcagaaagaacagcaagcaccacttcagtgtgctttcacccaggcacagaaagatcctgtccttccagttttttaaagagctgtggcagggctctaatgaccactccatacctatccacaagagaagttctaggtggtttgaggatactaaaaggggagataatgggcaagtctggcttacagaaagaatttgtatccacataaagagggtacagcatgagaatgttaacagggtaactgtccatgttattcaccacagcacagggctaatatcagaggctaaagcagcaaagaaattcttgaacacaaagccaaatctcaagaagttagaaaagagaaaggcaaatacaagaacttaatgagaaaatgcataaaggtaatcttctatgcaaccatggttaaactgtgtatttttagccgattgtgtgttcctttggaaattggcaataatatttcactggagtgtttcatttactctcccatttgataaaatgcagagaaaaccttggggttatctggaatatgacaaagaggtcattatatttctttttttattctgtattttaaaatattttccacattttattatctttccagattttataagtaatcatatgccagagtccaaattactacaatgaaatttagaatgctttgtatcatacttttaaaaattctatatattaactgatactgtattgaatttatattgattcctaaatacttaaaattgttatagtatcaaaactagctattaaagataaaatccatttataattttttataattagtccttcagtggaattttaatttttcttccatcagttgcatatgtatattatatattttatgtataacagatgacatatatgataaccatatatagaacatacatgtaacaaacatacctatatatgttacaggtatttttctcaatttgctgtcactataaatgggattttcttccccattatgtactctaatttgttaatgtttacgtacaggaaagttaatacttttttgtattgaattttatacttagcctctttataatattcctgcctcgatctaacagttttacaaatacaaaagaatgctacctggagtgattgttttacttctgcctttcccatatgtatgcttctaatttcttcctcttatttaattacattggtgaatactttcagagcaacagtttgaaacattgatgataactgcatcattgtcttatttctgatttaatgtaacgtcttctagtgcttactcttgtgttagagatatttttttcatcatgccagggaagattccatgaactcatgttatattattatttttagcttgttgtgttggtttcatttaaaaacgtatgttgaaatttgtcaggtcaagtaattattgataccataatagattttatacgtgatgtacaatatggtaattgtattagcatgcttaaatatccctgcatttcatgcatagtacgttaatttttaatacacatttttatgatgttttgtatgtacataaatgtgtataaaaatatatttgggcgatttcatttcttcatgaaacatcttttaaatattttcaagattccttttttttttatcccttagaaaacaaatactgccaaatcatctgttctccatccacttgaatagccttgataaacttcttaatttcttccatgaatattggtctttcctggttcacaatttctgtgaattaaattttggtgatttgtattttcttttttttgttgtgtttttttcaattctaaaagttgcattgtcttttttttatctaagttttagggtacatgagcacaacgtgcaggtttgttacatatgtatacatgcgccatgttggtgtgctgcacccattaactcctcatttaacattaggtgtatctcctaatgttatccctccaccctccccccaccccacaacagtccccggtgtgtgatgttccccatcctgtgtccatgtgttctcattgttcaattcccacctatgagtgagaacatgtggtgtttggttttttgtccttgcgatagtttgctgagaatgatggtttccagcttcatccatgtccctacaaacgacaggaactcatcattttttatggctgcatagtattccatggtgtatacgtgccatattttcttaatccagtctatcattgttggacatttgggttggttccaactctttgctattgtgaatagtgatgcaataaatatacgtgtgcatgtgtctttatagcaccatgatttataatcctttgggtatatacccagtaatgggatggctgggtcaaatggtatttctagttctagatccctgaggaatcgtcacaccgacttccacaatggttgaactagtttacagtcccaccaacaatgtaaaagtgttcctatttctccacatcctccagcaccttttgtttcctgacttttcaataatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggtggtttgtttttttcttataaatttgtttgagttcattgtagattctggatattagccatttgtcagatgagtaggttgcaaaaattttctcccattttgtaggttgccttttcaatctgatagtagtttcttttgctgtgcagaaagtctttagtttaattagatccgattcgtcaattttgacttttgttgccattgcttttggtgttttagacatgaagtccttgcccatgcctttgtcctgaatggtattgcctaggttaataacatggtatcttctagggtttttatggtttcaggtctaacatttaagtctttaatccatcttgaattgatttttgtataaggtgtaaggaagggatccagtttcagctttctacatatggctagccagttttcctagcaccatttattaaatagggaatcctttccccatttcttgtttttgtcaggtttgtcaaagatcacatagttgtagatatgcagcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggccatgcgggctcttttttggttccatatgaactttaaagtagttttttccaattctgtgaagaaagtcattggtagcttgatggggatggcattgaatctataaattaccttgggcagtatagccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacggggacagtttgacttcctcttttcctaattgaataccctttatttctttctcctgcctgattgccctggccagaacttccaacactatgttgactaggagtggtgagagagggcatccctgtcttgtgccagttttcaaagggaatgcttccagtttttgcccattcagtacgatattggctgtgggtttgtcatagatagctcttattgttttgagatacgtcccatcacttcctaatttattgagagtttttagcatgaagggttgttgaatttcatcaaaggccttttctgcatctattgagataatcatgtggtttttgtctttggttctgtttatatgctggattacatttattgatttgcatatgttgaaccagccttgcatcccagggatgaagcccacttgatcacggtggataaactttttgatatgctgctggattccgtttgccagtattttactgaggatttttgcatcgatgttcatcagggatattggtctaaaattctctttttttgttgtgtctctgcccggctttggtatcaggatgatgctggcctcataaaatgagttagagaggattccctctttttctactgattggaatagtttcagaaggaatggtaccagctcctccttgtacctctggtagaatttggctgtgaatccatctggtcctagacttttttttgttgctaggctattaattattgcctcaatttcagagcctgttattggtctattcagagattcaacttcttcctggtttagtcttgggagagtgtgtgtgtcgaggaatttatccatttcttctagattttctagtttatttgcatagaggtgtttatagtattctctgatggtaatttgtatttctacggtatcggtgctgatatcccctttatcattttttattgcgtctatttgattcttctctcttctttattagtcttgctagcagtctatcagttttgttgattttttcaaaaaaccagctcctggattcattgatttttttgaagggtttttgtgtctctatctcctgcagttctgctctgatcttagttatttcttgccttctgctagcttttgactgtgtttgctcttgcttctttagttcttttaattgtgatgttagggtgtcaattttagatctttcctgctttctcttgtgggcatttaatgctataaatttccctctaaacactgctttgaatgtgtcccagagattctggaatgttgtgtctttgttctcattggtttcaaagaacatctttatttctgccttcttttcgttatgtacccagtagtcattcaggagcaggttgttcagtttccatgtagttgagcggttttgagtgagtttcttaatcctgagttctagtttgattgcactgtgatctgagagacagtttgttataatttctgttcttttacatttgctgaggagtgctttacttccaactatgtggtcaattttggaataggtgtggtgtggtgctgaaaagaatgtctattctgttgatttggggtggagagttctgtagatgtctattaggtccacttggtgcagagctgagttcaattcctggatatccttgttaactttctgtctcattgatctgtctaatgttgacagtggggtgttaaagtctcccattattactgtgtgggagtctaagtctctttgtaggtctttaagcacttgccttatgaatctgcgtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctatccaatttgccagtctgtgtcttttaattggagcatttagcccatttacaattaaggttaatattgctatgtgtgaatttgatcctgtcattatgatgttagctggttattttgctcgttagttgatgccgtttcttcctaacctccatgttctttacaatttggcatgtgtttgcagtggctggtactggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggtgggaacttcttttctttaagaatgttgaatattggcccccactctcttctggcttgtagagtttctgctgagagatccgctgttagtctcatgggcttccctttgtgggtaacctgacctttttctctggctgcccttaaccttttttccttcatttcaactttggtgaatctgacagttatgtgtcttggagttgctcttctcgaggagtatctctgtggcatttctctgtatttcctgaatttgaatgttggcctgccttgctaggttggggaagttctcctggataatatcctgcagagtgttttccaacttggttccattcttcccgtcactttcaggtacaccagttagacgtagatttggtcttttcacatagtgccatattttttggatgctttgttcgtttctttttattcttttttctgtatacttctcttctcacttcatttcattcatttcatcttccatcactgataccctttcttccagttgatcgaatcggctgctgaggcttgtgcatgcttaacatagttctcatgccgtggttttcagctctatcaggtcctttaaggacttctctgcattggttattctagttagccattcatctaatttttttctaaggtttttaacttctttgccatgggttcgaacttcctcctttagcttggagtagtttgatcatctgaagccttcttctctcaactcgtcatagtcattctccatccagctttgttccattgctggtgaggagctgcgttcctttggaggaggagaggtgctctgatttttagagtttccagtttttctgctctgttttttccccatctttgttgttttatctaccttttgtctttgatgatgggacgtacagatggggttttggtgtggatttcctttctgtttgttagttttccttctaacagtcaggaccctcagctgcaggtctgttggagtttgctggaggtccactccagaccctgtttgcctgggtatcagcagaggctacagaacagcagttattggtgaacagcaggtgttgctgccttatcgttcctctggaagttttgtctcagaggagtacctggccacgtgaggtgtcagtctgcccctactgggtggtgcctcctagttaggctactcatgggtcagatacccacttgaggaggcagtctgtccgttctcagatctctggctgcgagctgggagaaccactactttcttcaaagctgtcagatagggacatttaagtctgtagaggtttctgctgccttttgtttgtctgtgtcctgcccccagaggtggagcctacagaggcaggcaggcaggcctccttgagctgcggtgggctccacccagtttgagcttcctgtttacctactcaagcctcggcaatggcgggcgccccttccccagcctcgctgccgccttgcagtttggtctcagactgctgtgctagcaatgagcgaggctccgtgggcataggacactctgagccaggcgcggcatataatctcctggtgtgccatttgctaagactgttggaaaagcgcggtattagggtgggagtgacccgattttccaggtgctgtctgtcacccctctctttcactaggaaagggaattccctgaaccttggtgcttcctgggtgaggtgatgcctggccttgcttcggctcacgctcggtgcgctgcacccactgtcctgtacccactatccaacactccccggtgagatgaacctggtacctcagttggaaatgcagaagtcacctgtcttctgtgtcactcagctgggagctgtagatgagctgttcctgttcacccatcttggctctgcctatattttcttacaatcatcagttttatctaagttctttaatttattttaatggaggttggcaaaatgctgtaattctttttatttttctctagttctatttcctcgttatatcttctttgtttacattctcttctttcttcaattaggctgtagagtaattgatctaataaagcttattgagagtcaactttatattttattcattccttctgtgcttttctgtttcattcatttatattttcacatcctttctgttttcttcagacttattttattgtttgcttcctagcttcatgagttgaaggcttgtttaattaacttaaattttatcctctttattaaaataagtacttaaggcaataggtgctatcctgacttaattttagatatacctcatatattttgataaaaaattttcccttgcagggcgcagtggctcacgcctgtaatcccagaactttgggaggccgaggtgggtggatcacgaggccaggagatcgggaccatcctgactaacagggtgaaaccccatctgtgctaaaaatacaaaatattagcgtgacgtggtggcaggcgcctgtagtcccagctactcgggaggctgaggcaggagaatggcctgaacccgggaggcagagcttgcagtgagccgagattgcaccactgcactccagcttgggcaacagagcgagactctgtatcaaaaaaaaaaaaaattcctttatggttattgactaagggtgtgacattttacctttgatttattctttaaaccaaaatttaagtgagagtttaaaattttccagctggagacttaagaaaacttacaataatcgaaatgaaacaatgcaacaacaaaaacagaaggatgggatttttttttaattttactttaagttccaggatacaagtgtagaatgtgtaggtttgttacatgtgtatatgtgtgccgtggtagtttctgcacctatcaacccatcatctaggttttaagccccacatgcattagcagtttgtcctaatgctctctctcccctcattgtcccccccacccccgactggccccgctgtgtgttattatcctccctgtgtccatgtgttctcactgttcagctctcatttataagtgagaacatgggatgtttggttttctgttcctgtgttagtttgctgaggatgatggcttccagctttattcatatcccttcagaggacatgatctcattccttttcatggctacgtagtattccgtggtgtatatgtaccacattttctttatccagtctgtcactgatgggcatttgggttggttccaagtctttgctgttggaaatagtgctgcaataaacatacatgtgtgcatgtgtctttatagtagcatgtgcctttgtagtagaatgatttataatcctttgggtatatacccagtaatgggattgctgggtcaaatcgtatttctggttctagatccttgaggaatcaccacactgtcttccacaacggttgaactaatttatattcagaccaacagtgtaaaagcattcctatttctccacatcctttccagcatctgttgtttcctgactttttaataatcgccattctgactggcatgggatggtgtctcgttgtggttttgatttgtgtttctctaatgatcagtgatgttgagcttttttcgtatgttttttggccgcataaatgtcttcctttgaaaagtttctgttcgtatcctttgcccactttttgatggggttgtttttttttttcttgtaaatttgtttaagttccttgtggattctggatgttagatgtttgtcaggtgagtagattgcaaaaattttctcccattccataggttccctgttcagtctgatgataatttcttttgctttgcagaagttctttaattagatcccatttctcaattttgtcttctgttgcaattgctttgggcatttttgtcatgaagtctttgcccatgcctatgtcctgaatggtattgcctaggttttcttctagggtttttatggttttgggttttacatgtaagtctttaatccatcttgagttaatttttgtataaggtataaggaaggggtccagtttcagttttctgcatatggctcgccagttttctcaacaccatttattaaatggggaatccttcctccattgcttgtttttgtctggtttgtcgaagatcagatggttgtagatgtgtggtgttatttctgaggtttctattctgttccattggtctatatgtctgttttggtaccactaccatgctgtattgtatactgtagccttgtagtatagtttgaagtgaggtagcatgatccctccagctttgttctttttgtttaggattgtgttggctatacaggctcttttttggttccatatgaaatttatagtgtttttctccaattctgtgaagaatgtcaatggtagtttgatgggaatagcagtgaatctataagttactttgggcagtatggccgttttaatggtatcgattctccctatccatgaggatggaatgttttttcttttgtttgtgtcctcttttatttccttgagcagtggtttgtagttctccttgaagaggtccttcacatccactgagggattcttatgcattcagcctgtcagcctaaaatctttagcattggccatgtggtgtggcttgccctggggtcctgtactctctaggattctttggttccagaaattgatcatctatattcatgtttgtgtcagacatggcttgagtcattcagaaacatggggtcactccttctacctcattccatcactagaaagtgacatttctttagtgaaagaagaaaagctgattcaagaatccttttgttgagtttccccaaggcctctgctagtcttcttataaagaccacaatacattttcatgggtttgtacagcagagtggcatagggagggatgtatgaggttaagaaagagtaacagctcaaacatctcattctcctgccaatactctaaaattctcttgccttcattccagcgttattatgagcagtggatgaaatgacaagagccgtaaaaagcccctattgtgacttccttgattctcctctttgactctgtttgactctcccactgacttcctagggaagatgtcaggagttgggttctgggattaaaattagattgggtggggagttttagccaaagtttctgggaataggaaatcctggaagttaaggggagataaagttgttcagaaaacagaaagacttaaggaaattaagatcaactgttaaatccacatttcagagcaaggctttgaggaacaaaatagataaaggagagcaataaagcagtatttcctgaacagttgacagaaaattgtcctggattccccttcttgaacatcatttttaaaatttttttaaattttatttatttatctatttatttatttatttatttaggcttctggcttcatggtgccagggaggatttattctgaagatggttattaactgaagcaaattgtcctataagattcaaatgaaattaattgcctccaattccagctcacatattttaggagaccttcagtcaatctcagattttctagggatccttggaaagtaccatattttgtttctgagggactctggctttcaaaatttttttattgctatttaaggattgtctttattttatacatatagactctgctctgtataacatctccccaaaggtgatatatagcccttctccttaatttacctcaaaacctctcacccagggcttttgtatatatgggaagctttgtggagtgttgggttgaagaattttacatcactttgttgttcacctcgtatgtcgtagagcagcactatccaatacaatagctactagctacctatagctgttgaacacttgatatggctggtgtgtgactgaggaaccaaattttaaattaaaatttatttgaattcaaatacccagtgtagcaagagaataccatattaaaccgtggaggtctagggtcttttattcatcttttctcagcatttttcctctttatctcctccctctaaaactcagttcctctctttgttatgcaaaaaaaccttgttttccatctattatatttaacttgggatctacttttgcacttctaaaactcataaatatgttctcgtaaatgatggtccatctgcccccagatcctacctataagaagcagagaactagccaaagatttgaatttttttcctgagcttgtctctccctcatcatatctgaaagcaaatacgtccagtgtaggaactgtctaccaatttatatgagttaatagctcccctctccttagcagaaagggctactcggttttggttttacgtagtcagttctcttctccattacaccccttacctttgtgtgcgtaagtgtaatacataggtaaaatactactgcagcctgcttctgtttaaacattataatattcttaatcctgacatacaagatttgaaataaacctgaattcaatttatgagagagcttaaatttggaaaacattgtcactggcttatatggataaagccataatacagtgttgtcattaaccatccatagacagtaatgaataccccaaaacacatgagtaggctaattatcactatattctctggaatcaattaacaagcattctgagtagactgataaaaattaatgcagattttccacacagtcatggagaaatgtatatgagtatttctgaaacagaacagtttcattcaggtagccaaaactataccagagaactgaacaaagatttatgtcagatttcaactaaaactcacctcttgggatttaaattctagagctgtaaattacagcttgacatctgctggtctcttaccaacagattatacctgagagtcctatggggtggaaaagtgattaggtgctttcacacttttaaacaaatctaatggcacttgttcccttgaaaattatttaatcacatgtcacctttatccacattttaacttcagtttgttgaggtgcttgttctcttttattatgaaccaatttttggctacaaatatttaacgagaaatgtggtaacttctggtttccgattcagcacataagaggcttgaaagtcatcactctgtcctaacaagtaaaaagctgcacaactgaaattcaacaactcacagaaaaaaccattgcccctcaaactggagagacacacaggcaggtagaatcacagcttatcagatcagaaacctgtaagcagcaatcagtactatggtaggaaaacctaaactgtaattgacaaatttctggaggctcaatgtaagcaaatatgagattttaaaactccagggtgagggacatcagcaagatggcacaacaggaaatctcagccttcatacctccatagaaacactaatctaccaactatctatggaccaaaatacctttatgagaactccagaatccacttcagaagttgcagcactcggaagagcaacccccctcccaaaaaaaaagtacattaaaattagtaaaagcaatttcactttacccacgttaccctatcccttcacttggcacagctcaacaccaagagttacccttggcccacaatttcccccatgggagaaagggaagactatccattcaacttccccagccttttgggtcatcatttgggagacctgcttctgtcttgcctcacccagagttctgaggaaactgacttacatagaaggcctgggagcagctaacctcaaagaaaagttggtggagtggcggttcgggggggcggtggcggggagggcagttcatggtctcagcagccaatgcacagatctcagagccagcatggctcttagcaatcttagcagctggtgcagttctcagcagccagtgtgcagacctcagcagccagtgtatgtggccctcagcagctggcactcagctctttgcagccagtgtgaatctcggcagccagcttggttctgcagaattggcagaaggtgaataatcttgagacttctccttcatgaggaaaaaaacagtagttaaacttgcacccaaagtcccagcatcttattctcttgccctagggaaaagtattgggtggctgtcaactgtaaggattatgcaccatgatcaagtggaatttatccctggatcattcaccatgatcaagtagaattcatccctgaaatgcaactataattcaacatattcaaatcaataatgtgatacatcacataaacagaacgaaggattaacagcatacaatcatctcaatagctgtaaaaaagcatttgacaaaattcaatatcctatcatgattaaaaaaaaatgcaacaaactgggtatggaaggatgtaccacaacataataaaggtcatctatgaaagcccacagctaacatactcaaaagtgaaaagctgaaagcttttcttctaagatccagtacaaggcaaggatgcccactattgccacttctattcaacatagtactagaagtcctagccagagcaattagccaagaaaaaaaaataaaaagcattcaaaatggaaaggaaaaagtgaatttatctgtttgcagatgtcatgatcttatgtatagaaagccctaaagaccccaacaacaacaagaacaaaaactgttagaagtaataaattcagccaggcacagtggctcacgcctgtaatcctagcactttgggaggccgaggtgggcggatcacaaggtcaggagttcgagatcagcctggccaacatggtgaaaccccatctctactggaaaaaaaaaaaaaaattagccgggcatggtggcatgcacctgtaatcccagttacttgggaaggtgaggaaggagaattgcttgaacccgggaggcggaggttgcagtgagctgagatcatgccactacactccagtctgggtgacagagcaagactccatatcaaaaaaaaaaaagtaataaattcagtaaagttgaaggatacaaaccaacatatagaaatcagttgaaattttttttttttttttttttgagatggggtctcactctgtcacccaggctggagtgcaatggtgtgatctcggctcactgcaacctccgcctcctggattcaagtgattctcttgcctcagcctcccaagtagctgggattacaggcacccgccaccacgccccgctaatgtttatatttttagtggagacggggtttcaccaggttggccgggctggtctcaaactcctgacctcaggccttggtcacacccaagtgatccacctgccttagcctcccaaagtgctgggattacaggcatgagccaccacgcccgacccaatcagttgcatttttatacacatttacaaagaaatttaagaagacaatcccatttttaataacatcagaaagaataaaatacttacaaataaagttaaggaagtgaaatatttgcatctctaaacatagaaaaggtacagtaaaaatatggtgtaaaagatgaaaatggtacacttgtatagggcatttaccatgaatgaagcttgcaaaactagaagttgctctgggtgagtcagtgagcaagtggtgagttaatgtgaaggcctaggacattacactactgcagactttataaatactgtacacttaggatacagtaaatttattttaaaatgtttttcttttttcaacaataaattaatcttagcttactgtaatggcttttattttataaacattttacttttttaactttttgactcttgtagtaacccttagcagcttaaaacacaaatacagtgtacagctatctgaaaatattttttatatccttgttctatgaacttttttctatttttaaagtttttattttttaaaactttttgttaaaaactaagacacaaacacatattacgctaggcctacacagagttaagatcatcaatatcactgtcttccacctccacatcttgtcccactggaaggtcttcaggggcagtaatacccttggagttgtcatcgcctatgataacagtgccttcttctggaatccctcctgatggacctgcctgaggctgttttacagttaccttttttttataagtagaaagcatacactctagtgataaaaagtacagtcgaataaatacataaaccagtaacagagttgtctgtaatcatcaaatattatatactgtacataattatatgtgctatacttttataaaattggtaacacagcaggtttgtttatgacagttgcaatgtcactagataagaatttttcagctccattataatcttatgggaccactttcatatgtgtggcctgttgaccaaaataccattatgaggtacatgactataataaaatttagatcagatatcagtaaaactaaaaaaccaatagagaaaaaaattaaaactggttatttgaaaagatcgataaaattaataagcctttagccagactaagaaaaacaagcgagaagacacaaattacaaatatcagaaatgaaaaagggcatcattaccttccccaaggacattaaaaagataacgtgaaatattatgtgaaacatatgtgaaatagactaattctgaatatgttgtatatgataaaacagagaatctgaattagtctgtatcagagaaattaaaaaattaataaatattccaaaacaaaaccatcaggtccagatgggttcactggtgaattctaccacacattgatggaaggaattatatcagttctctacaatctcttccagaagatagaagcagatagaatactctctaactcatcctgtgggaccagcattaccctaaaacccaaaccagacaaaggtattaccacaaaactacagaccaatatctctaatgattctagatgcaaaaaattctcaacgatttgtgaaaaaattcttataccacaaccaagtgggacttatctcaggtacacaaggctggttcaacatttgaaagtcagtgaatgaaattcattcacatcattaggctaaagagggaaaattacacaatcatattaatagatacataaaaagcatttcgcaaaatcgaagttttttattcataataagaactctcagcaaacgggaaatagagggatattttcctaacttgataaatagcatttacaaaaaaaaaaaaaaaaacttctaagatcatactaaatgatgagaaactaaaagctttcctgctaagatcaggaacaaggcaaggatatcccctttcaccactcattgtcaacaacgttcaaatatagacccacgcaaatgtactcaatatagttaacactaccctacttcaagcattactctaaagccccagtaatcaagacagtttgatattggcaaaacagaaaaaaatgcatcagtgaaacaatacagagccccaaaataaaaccacacaaatatagtcaactgatcttttacaaaataacacaggcaattcaatggagaaaagatagtattttcaacacgtggtcctggacatccacatgcaagaaaaattaatctggacacacacattatacccttcaccaaaattaactcaaaatgggtcacagacctaaatttaacatgtaaaactataaaattcctataagataacatgagagaaaatctagatggcctgtgttcggccttgacttcttctgatacaataccaaggtaagatgcatgaaagaaataagtttttaatttcagtgaattccaacttatcagttatccgcaaacaaaaacttaagagaataaaaagacaagttacagatggaataaaatatttgcaaaagatatatctgataaaggagttacccaaatacacaaagaactcttaaaaatcaacaataagaaaataaggccaggtgcagtggctcacgcccgtgatcccagcattttaggaggccaaggcaagtggatcacttgagctcaggagttcgagaccagcctgagcaacaaagtgagaccctatctctacaaaaactgcaaaaattagctgggcatggtggcgtgtgcctgtagtcccagctacttaggaggctgaggtgggaggatggtttgagtctgggaggcagaggtggcagtgaactgagatcgcaccactgcactccagcctgggtgacagagccaaaccttgtcacacacacacacacacagacaaacaatatgattaaaagatgagtaaaagagctgaacagacacctcaccagagaagatacagatggcaaataagcctatgagatgatgatcaaaatcatatgtcgttagggaaatgcaaattaaagcaacgagataccgctacccacctattagaatggtaaaaatccaaaacattgacaacaccaaaagttgacaaggatgtagagcaacaggaactttgattcattgctgatgagaacagaaaaaggtactgctactttggaagacaatttgacagtttcttacaaagctaaatatactcttgccatacaatccggcaatcgtgctccttggtatttccccaaaagagctgaaaacagccacacaaaaacctacacatggatgtttatggcaactttgttaatacttgccaaaacttggaagccaccagtagatgaatgtatgaaatatatgtcttatttcattcaggctgctgtagcaaactaccagaaactgaatggctcataaacaacagaaatttatttctcacagttctagaggctgggaagtcgaagactatagtacccaaagattcagtgtctggtgagagcctgtgtccttgttcatagttggtgccttcttgctgtaccttcacatggtggaagggacaaggcagctctctggtaccccttttctatgtgcactgatcccaattatgagggctctaccctcatggcctaaccaccactcaaaaggttttacctcctaatgttatcaccttgggtgttagaatttcagtatataaagggggaaacacaaacatttagaccatagcactgtggtacatccatacaatggaatattaatcagcactgagaagaaatgagttatcaagtcatgaaaagacatggaggaaacttaaatgcacactactgaatactacataagtttctgaaaaaaggcaaaactatggagacagtcaaaagatcagtgtttgcaggggagggcaggagagatgaataggcaaagaacagaggatttttggggcagtgaaactattctgtatgacactgtaatatttaatatatgcctatatagttatgtcaaaacccgtaggatgtacagcatcaagcatgacccctcatgtaaactgtggacttgggtgataatgatgcatcagtgtgctttcaccaattggaatgaatgtacccctctggtgtggggtattgatagtagagcaggctgtgtttgctggtggatgagaggggtgttaagtatatatgaaaactctctgtactttcagctcagtttttctgagatcctaaaattccgtaaaaaatagtctattttttaaaatttagtgagaaataattttccttttaccaatgaaaagtggcctaaaggagacatagttaaaatattattctaattaaacatgttaattagagaacgcctgtatggtgagccaactgaactttctgtcaggatactcattcctgctgggccacatttttaatgttcccaaaagtcactggaagcaattaatggcaaaagatattgaattttctctgagactgtatatgtttctacaagatttgcatagtgaggcccaattcttgctattgtagctgtagattacattattaatttattacagatttattacaaacttctacaaaacgtagccacagagcttgataatattggaaagaatgtcaccatagcccctgctttctgtatactccaaatctaacattatgccactttatgttcttataagggagtgtcatgcaggagaggtgtccagaggatgacttttctgagatctttctatctagaaacaaagggaatataattttcttgatagcagaaaaatgactggtaggaatgatgcctctagacttgggtgagaaatctgttctgcacacaaccctggaaagatacatatcagagaaacgtgccaatagctaacctggtgaaacccacttgttctaaaggctactggtatctctatgaaacttggaagcctcctatatttgtactgctgaatgtgaaggctaacatttcttctatcacattgctgtctaggtgaatacaattgtttcttttcttttcttttttttttttttttttttttttgagacggagtttcactcttgttgcccaggctggagtgcagtggcacgatcttggctcaccacaacctccacctcctgggttcaagcagttctcctgcctcagcctccccagtagctgggatttcaggcatgcaccaccatgcctggctaattttgtatttttaatagagagggggtatctctacgttggtcaggctgttctcaaactcccaacctcaggtgatccacccgcctcagcctcccaaagtgctaggattacaggcatgagccactgtgctcggctaatgatttctttcatcagcaaaataaattcatattttactaaatgtctgcatctgtgttttaatagtagagcacaattcataatgtttttggtttgtgttatagttctaaaagcaaagcaaactgtttaaaataaaatttccttaattccccaaaactataaggctagttttagttttaatgtcacttcattcatatgttcattcaactgtaattgccacttcattcctccattcaactattcagaaattgcttttagcatctactatgtggcttatattttgcctagccttcaatgaattttgtgaccatcattatctttgttttggcacacaaagagaaagacacctgataacctccttggaaaaggaagaatgttgtgcctcatccacttccgtctgtatatttgatatgtctttctattcgtacccaccttatctttgaatagcatgtttagattatgtaaatacatgggccaggcgtggtggctcatgcctgtaatcccagcactttgggaggcccaggcaggcagatcacttgaggtcaggagtttgagaccagcctggccaacatggcaaaaccctttctctactgaaaatacaaaaagtagccaggcgtggtggcgcatgcctgtaatcccaactgcttgggaggctgaggcacaagaatcacttgaactcaggaggcagaggttgcagtgagccaagatctcgccacactccagcctgggctacagagagaagctctgtgcccaaaaagaaaaaaaaaattatatatatgcaaatatgtatattttcttcaatgtgaaagattttggtttagtataatgaaaataaatatagaagcaaatcactgtactaactctgagggaaaatataattattaatattgaaacatattttccttgacagggcttaagtttcgcaaaatcaaaggggaaaattatccaaaaaaccataattcgtgctattttaaaatctgccacatcagtgaaacatggaatactcatctgtatctcctttccacatttagaaaatgtgattgtacacatatattgtcttgggaactctgtccctgcttttgtgatgatcgtcaccttgttttcagtgcaagttcgtcttctccatatagtcccagactttattaccaggtagccctattcattctgaggggaaaaaattacagaagattctaagacagttaattcagaataatgtaatgatctcctataggttttctcttttatatattttgagccagaagattctgcttttttataccatttgttacattagatacatgcacgcctgaccagattatgtgtgaaactgagcgccaaacatgggtgaccttgaataatcacccttttcctgtttctctctcgtttattcattgtgatttgtttcgtatctcatccatctaattatattgatgtacttccccaacagaggaagtgtctcatggagggtgagagaaacaacttcagagaaaaataaaatacaaggaaggcccagagtcgaaataaatggcagcataaaaggcactagcaacaaataactgcttgccatattgagacactgtgggagactcccaagttgcccagagatgctattaaattcacactgcctgacttcatgccattctcttaggatttacagcaactgccagaagccaattgaagtttttccaggctattctccacctcctcttccatattcttaatgttcttaaaagccattgaaagaagttaatgaaaaaggttgtagaatttttttcttttaaacctagggtgaaataatggtgtctgagggaccatttgggttctatgtgaaggcacaaatacctaagtaatctcttaaggattttttgttttatcaattacacaaagatatttttaattaaaatattacaatagaaataatgatagatttagtgtgtggaagataaagcatacaatttttaagtatgcaaatatagccaaactaatatgccagctatattggcaagagatgcttttggctgaaagaaatgtaaattttacccaagaagatgatcagaggagatgatggtaagtagtgttggggcagatgccccttaacgtcactaaagatccagattcttgatctttttgtgctccactgtcttgggtgtgttggcctttggtcttcacgttttggcatcattatattgaggagagttctatagctgcagtaatgaagtccatgtgaagaagggaaagggctggtactgccacacttgtctgatttattagaaaagaaaaattttcctagaagggcactggcatacaaccccttacatctcattacttggacttggctcatatgtccacttctagattcaggaaggttggtaagcttattttgggggctattattatcgtttataatgagaagaaagaaaggggtgtgaagggttgggatgaccattgggccaaacaaccaggagtatctgccacacaaactaaattcattggcttttatgaatctttgtttcatgcaccataagtatgtgactcttgaagataaataggtattatgacagaaaacttgctatacaattccttatcatgataaactattctttctgtatataaatccttgggttggttaataagggaaaagttgatgtaaattaaaagtgagattacaaatgtcagtcattttattaaagatacaaagaaaatgataaaaagattatgaaaaaatattggatttttttaatttaaaaaattagctgcataaactctatcaaaagtttcaagttaaaaaaatgactaaatgtcattgttcgaaaaacaatgtggtaaatagagatttgaaaaattaaatgtcattggactttataatcattagatttctaatgtggatgcctgtgacaaacaattaagcttcaacagttggatgaatcattatcattctttgacttcgtcacatggggcattctcttttttaattgcagactgaatatatttcagatgatgttgataataattattgatgagtgaattacacgggattgtgaaatttgatttcacttggataagaaaagtcaaacaattgagcgattaaattccttccaataaactgagcttctggaaaatcagcttgaaatgacattgaggaatctaatttaattcctacatattgtgtgctaatgtaaccatggaccaagggttttgcatcacagactaatatttgaagttagaaaagagtttagagatcatcttctgtcaccccagatcatacttggtggaagtaaatgaggtttaaattaactcctttaattctttagataaagaactttatcttagaggcgatttagtgatttgatcaagatacagtactataactagttaaatcaagaactggaagcaaattagcttcactctcgcatcaatatgcaatctactagttttacatttttctgtaaattagggtcatgtcactatttcactttctactttatatactacatcaaaaaagtgataggaataaaaattgcagatcagccacaatttctaaatgatgctaatgtatgagaggtacaaggtaagggacctgcatatacatattaatgtagccaattactacaaataatcagtaatccacctagctagaaataaacaaaatgttggacttaaaagaaaaacgacaagatagctgatcaaagtcagacaacagggtaaagatgctctgttgtatttcctctacgttgtgttctccaagaaatcaatttgaggggaggacaatgaaaatatgtgttgcagtcagatgattgagttctcatctggggagttataaaggtagttagagaaagaaaggttttctgtgaaccccgtctgtattctcttacatttgctggggtcaaagtttccttggaagtctaaaaatagttttccatttttcccaacaggagtgtttttttgtgtgtgtaattcaatacgggataataacaatagctaatatttagtaagctctttatttgtttctagagctgtaactcatgctttggaggcttttgcttacttgattttcacaaaaattctgtgagataatgtggtagtcattagagctgatcacgaatatttcttgctcttctgggccatggtaagagtgttctccttcccctcccttggagttaagtatggtcatttgtattgcttttagtcaatgacatgtaagtgaaagtggtgattgtcatatctatgtggcatcttcaagaaccaatatgcaattcatcaggatctctctgtcctctgctagtgctactagcagtgttccagaaagtgtgctctattagcctgtgtcttacagtgagacccactggagcacagttcttagctgccttgcaatatgaatgtagaagaagtgagaaataaactttggattatttgttattgcaacatagcctaattcattctgactggtacatgtaattattatttctattttctttaaagaggaagaaaatgaaaataagtgatctgtcaatgatgacaccattagttaagtagaaccaggatgcaatccaagtagtctgactccacagctcacattgtaatcactattttatatagctatggtaatacactttattttgaagaagattgtccactaatatggtgcagagcccttaatttctgagcatagagaggtgataattacttttaattcacttatgcttgatatacttttaatatttacaaatcacacatgtataaagcccactactcattccatcaatagtatatggctgaatgttgttgccctcagggaagaaaagagtatggagagatcatcaacacatatttctaggggtcttttgcaaatattctggtattagtctatttgggctgccatatcagactgagtagcttaaataacagaaatgtatttttgcacagttctggagagaaggagttcaagatcaaggcacttgtcagtttggttcctggtaagggctctcttcctggcctgcagacagtcaccttgttgctatgttctcatatggcagagagagtgtgtgtgtgtgggtgtctcttcctcttcttataagggcaccagccatattggatttgggccccactcttatgacctcatttatcatctcacagaccctatctccagatacattcaaaggagggttagggcttcaatgtatgagtctggcaggcagtggggattggggacacaaacattcagtctataacaatctcctaggaactatgagcaatttaggacattttagtaataaagacttgttcccatctattgtccagtatatcctgtctctgtacatgcaactggaaggaaattccaatgagaagtattctattaattcatttattcacttacttagtacatctattgagcatctatcatgtgctggattattctagacattggggtatagcaatgaacaaaacattttttatctttcatttaatttatattttaatggagggaaacagatatgtgtgtgtgtgtgtgtatatatatatatataaattacactactcaagagagtgatatattaataaaaataaagcagaataaagatgtacagaatgatagagtccagaaatgctactttgtcaattatacacagatacattctctcagatcaggtgacttttttgcagagaccaaaatttgtaactttaacattttaaatattaaaatggaaaagataatgagagagcatattcttagattctttcattttacagatagataaagtgttacctagaacaggggttggcaaactctttaaagggccagttagtaaatattttcacttttgcaggctagacagtgtctttcataactaaccaatcctgctgttggagcacagagataatacataaacaaaatgtgactatggtctaataaaactttatttatgcacacaggcagttggtaagattgtctttcaggctatagcttgtctagccctgatctaaaacaatgaaatgactttctcagggtcacacatttgatggctgatgacagaagagatgacaaacatgtttcttctatcattgaaaacaacaaaggcatctttagagcaagttatcacaaataaaaaacaggattaaataaaaaatatgtcaaggtgaaaaaaattacccactgaaccgtggcacctgaatttattttaaagagggaccggtctttgtttaggaaaacaggtggataagttatttctgggagaaggtgataccctgagggcctggtttagcaggaagcaataaaacagaagggatagctcaatggctctgcattagaaatgatcagaaattaagggaaaaggaagggagtagactagaacagacaaagtagagaaagggaaagagtgaagagccaatcaacagaacagtgagcaaaggcattttaagcaaaagatgtgtaatcgattttaattgactgaattgccgcaatgcaaacctcctgttgtccttcaaaattaagtaaattggtgcacaaatcaaaaagcttttatgaatgggtttttgaggatgtatgtgtgggagtaggaagaattaaggaagctgagtgtcttgtctgggccaattcttttatgtgtgtggcatttaattaaatcccaaccttctatagcacaaccatctgtttttgctattcctgtaaacattgccagagaaagtccttttaatagagtgtattggtccagtcataaatagaaaaatctctccaacctcaaagggtccctcaacagtgcctgtagactctcctaccctttgcaacagctgtttcaaaccttctttgctcaaagcatcaagttttctcctccacctctccagtttatcagacttaacctgacattttaaaagaaaggagaaggcatcagttgataactcttttatctttccctcacctaccaatcaaatctctacccttgcagtatcctccttctcttctgtgaaaagagagggctggctcttcccctatataagttcatgccacctcatgaactatacatgatttgttatccctcatcactgtcatattccacactctctcatggaactgaatccttcacatcaggacttaagttactactatttaaaaaaaaaaaaaaacccttctctgtcctacatgccactacatctactaccctgccccttttctcttctctaccacttagcttcttggacaagttgccggaacaactctttaccatcaccttcggcttaaaatctgttttttttggatcacataataatagtaatttttttcagggatgcatctctaatctcctacactagataaaatctacttattttatgtttttgtaccaccatactcagccccatcatagcacttattcataatgttctatttatcgtgcaatcattaatgtcttcttcccacactaacctattgtttcccctacaaccagcccagttcctcacacataatgtagcgtaacaaataacagggtctcaataaataattgttaaatgaatgaatgaatgatgccatgcagaatacactggataaacactttgtaaacactttctactatgtactaattcagaataagcaggatggtaaagccagtggtgtccatgacattatgacctctttgtgaatatgcagaaatttaggaaacggcattgaacttcctatgagccatgaaattaaaggttaaacttttctaagctatagctgacaactggattgtagtaaaatttatccagtatgtgcagagtgcaattcaaatggagaactaagaaaaggtgaaaaatgtttaacttggtgatattacacgggaccactattggggcacagaatgagatctggagtaatctctgcacttgcaaaacaaggacttcacctgccaaatggctcaacaattttgtgaatttttaatagtgttgacctcactccaatattttataagggtatattgtttttcaatagtatgtctcattaaaaaataaaaagttaattagtatgtattataaagtaaagtccaaatcgaattttcactggagttatctcacagagggacatcacacctgctacattaagagccagtgatgctgagcaaaacctacttaatcagatcttaatacccctttttggctggaagggatcattgtagtcatggaacatgtcatattttacgtattttatgtcttgagttttgtaagcattagataaagctgtgattcccaggtatgaatccaagtctttcatcagttctctgacaagcactcaatgttccatgagttggttcccccaatttatcgtctccctttttgacccaaattactcacagctatgatccaacattggcatagctcctaagaaggaggggcatataagagctgttattgggcaaataatagaagctgtcacacaacctatgtttagttacaaaaagtttgcaaactttgaaaatgctggctgtcagacttgtgaaagattctcattgggaagggaaccccgttatttagattggtatagcattcgtgcccaagattgggaatcataccacttgggctattaatcatttttagaggtaaatacttcatgaatgactgtttgagggcaaatctaaatagacaaagttgaagagatttgacaaacagaaacacattcttacatataatgaatgtgcaaatgtataagggcatttgaaacaatatagatatacttgtctgtctttttatgataattaatctttagggacaaaagtaaaagttgttcttccttctgctgactttattttctctgtatgaagaaaaacatcacgacaaatttatctgttgccatactagaatcaaggaaatttaggaaagcacccctagaagatcacaacgtctacccagttctcaattgtactttattttcaagtcgaaaacttaagaaattcataaatattccagatccctgagcatcagagagataattgtcgcatgttcatatagctagtagtgacaaatctgggattcaaactcaagtgaatggatttcagaaatcaggcttttacccggtctgtcagtcaccatcttattttgtttcatatgttgacagaacttaaatatgatttaaacaaaggcaaaacagaagtcagcaggagtacagatactgactatagtaacatgcttactcactccatatgaagccaattgttttatggaattattcggttactaaaggggaacttcctacaaccccaaagttattcagagctttaaattccatagattagcattttacatcaaaggcctattagttttatccaataagaagatacaagttctgtgtttccaagtacgtggagaagcaggaattctcatcctgagctgaagaaaagtgttccaatattctcaataggcacgtaagaataaagttaattctgacatttgatgtacacagttggctttttcgtttaaaagtattttatgggattcactgccacagtttttgagtgcaacataatcttcaagattacaattgtgtaatattgttaaaaaccaggtaggtaatatgcagcagtactttttaactcaaagaaacttccacactcactaaaactaggcactagtgcagaagtctcttgagagcagagtggttttatttttaccgctggaaaaaactgactttggaaattttcagtatatttctgaaattattctcccaggaattggaagcttaaaagaaggagctaatgttattcaatttgtcttaaggtattgatccagatcacgttgaggtctacgcttaatccctttggaattttttttcttttcttttcttttcttttttttttttttgaaaaataggccaggggcataatagatacccagaaagataatcttcagcaataaaacaaccaaaactgtagataaaacatattttttaaatttttgaaaatgtgtgaatgagtcagcagaaaagtaagggaaatcctaagaggtcaaaaataaagtaataactctagagatgcaagcaagctcccaaacaggtgcttgccctacaacttcagccaaatggagagtgtaagtaaagctgagggttcagaaaatatatggaatcatatttgatgttgttgaataacatagggccccaagggttacacctccagtgaaagattactaaaacgtacctgacaaagggagacagtaaggaaactattctgtctctaaaccttgcgtctgtatctcccctaatatgtgtttggggccttagtttatatttttggggtggtccaaaaagcctcaagccaaagaattatattagcattgtcttggatggtaatgctcatgagtgcttggcaaaataaaaattttttaaatcatccctagaagatcacaacatttacccagttctcaaaatatctccatagaaaaagttcatacacatatgaacttgcaaaaaaataaaaaaaacacaagacctacacaaaagtaaaacatcgtgaaggaaagaaagaaacatcagctggtgcccaaaagcagaagtggaaatacacaaatgctttttcaagtttattattgtcccattagcaaaaaccagtttcatgacctagcccagggtcactgtgggtgggcactaccataaatgctcaactacatgagcaatcaagaaaagagacattacaaaaagttatacttttttatacttttaaatttttatcaaatttatcataagttcacatatgttagagtcaaatgcttgtattctaatttttatgcaacatagtttcttaccatcaccctactttccccttccagaagcaacatgcaactctttctggctgattctttcagtgttttgttgtcgtcgttgttttgttttgaaggtagatggtgcaagagagtattatttaggatcaaataaaaattgtaagtaaatctgaaagagtagcaatgaaaaattcagtctctttaatgtaaagagtattattacatttcttcttaatgttgttaccccttagaatgagatggagagcaatatgcatctgtttctttatttcttttttaaaaaaaacactttgttgaggtacaattgacaaaataatagctgtccatactgaatgtatacaacttgatgaatttggaaataagtaaacactagcgaaaccatcaccacatttgataccataaacttaactatcacctccgaaagtttcctcctaccctctttatttattttatgataagagcacttagcataagatctaccctcctagcaaatttttaagtatacaatacagaattgttaagtaggtgttacgttgtacagtagatctctagaatttattcgtcttgcataaccgagacttcgtaccctttgactaatacctctcaattttcctctactccagctcctggcagccaccattctactctctgcttctatgagtttgataattttagatttctcgtataactgaaatcatgtagtatttctccttctgtttctggcttatattatttggcataatgtcctccaggttcatctgtgttgtcacaagtgtcgaaaactataaagcattgataaaacaaacagaagatataagtaaatggaaagacatactgtattaatggattggaagaattaatattgttaaaatatccatactaccccaaacaatctacagattcaatacaataactatcaaaattctaatgaccttttttacacaaatagaaaaaaatactaaaatccatatgggaacaacaaaataccctgaattgccaaaacaattttgagcaaaaagaacaaagctggaacgtcacatttcctgattctttcaggatagacttgttgatataaggttacctccatacttctaaataatgtggttttgctttttttaacttattcttccattttatggtatgccattctcatgctctgtatcaactacacgtgtatacttcctgtcccctcctttactttccaatataaaatgtttcaattttcttttcatcactattcaatgtttgaaccgtcataactatgaaaagctttttcactacataattataaaaagataatgtgccatgcttttcctgcccatttttttcccttggagataatgatggtctagttttttgtttgctttgggctttttctgtattattagttattcaacctaaaactctctagcagttatgtaaatcatacctcaatacattcatatgataccattattctaagaattaaatcattttaaagaaatcacctctgtcttctgacaacaagcaggagtggttgccctctactcctggggcatggctattaccctgggatatcccttcgttattattctgattccctttacttacttccatttgaataatccattttgtgagagccgtttcctcatttccctcatgttgttggaccatagcctaaatagcttcctgagaaatggggtatagtagataaattgtcgtgagacttttcgtgtggtaaaattttctttttgttctattatataactggacatagaatcttaggttgtaaatattttttctcaaaaatttgagaaaattagaaatactgcatccatggattagaagactcaacgtagcagagatgtcagttcccccaaatcgatctctaggtttaaagcaattcctactaaaatccaagcaaagctttttgtggacatatacaaacttattctaaaattgatatacaaagacaaaatcactggattagctaaacaactcttaaaaaagaagaatgaagtggaaggaatcactcttccttcctataaggcttaccatatagctgcagtaagcaaaatgctgcgttattttttgacaggagtagaaacatagatcagtggtatagaaatagaacctaaaatagggccacacaaataagcctaattattttacacaatgggaaaaccaaattcaatgtaggaagaagatccttttcaacaaatggtgctggaaaaatcagacatctggatgcaaaaaaaaaatgaatatagacctaaatgagcatcacacatgcacccatgacccagcctaagaaactgatcattaccaaaacaagtgaagctccctacatgtctatctcttttcacaggcattcccttccagctctactagtaaccatcaacctgaaagaggtattatttgtgaaatcagttgaactaaacataagcagctttagaatatagttctcttgaagcagtgtttctgtacttgaatgaggaatgttaagttcaaatacttttcagagttttttttttagtagatgcgcattttgcattacgttttactttataatatatcaaatataaatttcaagttggaaaagaaacatcaaagtgattcttttgccatcctacagaataatctttaagactattttggtgcagatggagtgacaggaaggttgaagttttttaatccccgaagactgacaaaatctagtccatgtttttcacccattaaagacatagaacatttctgcaagagactgccttaaggaaaaataccactcttctttcaaatactgaaatggaagagtttcctctaaatcccaaactgtcctcatttattttattttatagttgctttgaatacttagaaaagagtagcacagtgattcaaaagaccaaaagtggcaacaatgtgttgaccattctggtcttattctccaaaccaagtgtcagatcatgcccttgttagtaccaagagggaacagttctggtgcaaagctggactatgtgaatacttctaaattatgtacaaagtattcactaaggcattctaaaagctccaattaaagccacagttagtgcttaccttatatgaatggagaaatataaaatatattctcaagcataaaaaggtgtctagttttagataaatgatttgttatatcattacagtctccccacaaccaaaaagtaaaacttgtttgtgtttctttctttctccaaattaaaaaaataaaatttcataaaacagtttcagtagtgcataataaatacatatttgctagtttgaaagtaatgctagaaaatattttctgtgtcagtaaagcgatattacaattttccaattataattttccaactggttcccttttttgtagacacttgaaaggttttcatgtctttgaattagtatgcaaagtcctaagctatatcagcttagagttttgaatgatggtattttaatttcctgtgagaattacatttaattcatacacacacacacacacacacacacacacacacacacacacccctcataatcctcttctggaaaacaacttcaatatgggctaaatagaaatgtgtaattctaaaagagaatgaatctgagtttggggccaacatttctacttccaagtaaagaagtagaaatcacaacataacaggatcatacaatcttcctcctcagtaacagaaatgccattaataatatactagtactattaatagataacatctattccgttgcacttccttccatcattttatatgtataatctcatttgaacatcatgaatgctctatgaagaaagtgggctggatcatctattaagctgtcttcatcatcgctcccgtctgagttcttctagagcattgcagatgagaaaatggacactccatttcgcaaaatgctgcctctgttttgggttgttaaatcgagtctgcccaaaagtggcacccaggtaagatttcagagatttgggggagatgtatgaataaacactatattcacagagcttctaggggagtccttgaaaatgtctctactcactgctgtagattaaggtggtcgttgacatcttccaaagattctttgagttgcagcggtttacaagtttgttcttttatatatatactttaagttctgggttacgtgtgcagaatgtgcagctttgttacataggtatacacgtgccatggtggtttgctacacccatcagcccatcatctacattaggtatgtctcctaatgctatccctgcccttgcccccaacccacccacaggccctgatgtgagatattcccctccttgtgttctcattgttcaactcccgcttatgagtgagaacatgtggtgtttggttttttgttcctgtgatagtttgctgagaatgatggtttccagcttcatccatgtccctgcaaaggacatgaactcatccttttttgtggctgcatagtattccatggtgtatatgtgccacattttcttaatccagtctgactgatgggcatttgagttgtttccaagtctttgctattgtgaatagtgccccagtaaacatacgtgtgcatgtgtctttatagtagaatgatttataatcctttgggtatatacccagtaatgggatggctgggtcaaatggtatttttggttctagatccttgaggaatcgccacagtgtcttccacaatggttgaactaatttacaatcccaccagcagtgtaaaagcgttcttatttctccacatcctctccggcatcagttgtttcctgactttttaaggatcgcctttctaactgggggtgaggtggtatctcattgtggtcttgatttgcatttttctaatgaccgatgatgatgagctttttttcatatgtttgttggctgcataaattgataaattgatcttttacaagtttgttcttaaccatctgcttgggtgcttcattctgaagtttttgctggccacttccctgaactgtgctccccaagaacgtccaaagcttttataagcttctagtttcctgttttaaaacctttcatacttgatatagacagagcaacttctgttttcttggctgtaagtggaaagaaaagtgacgttggacttgacatctttcaaggcatacatgtgtgtctggaaaataagccaaaccacgaggaagtggagtacacctctgagcaggtggaagaagtcctgaatatttaataaaatataattaaaagaatacagatcctatgtcttccccaaaattaaccacagcctcttgtacataggctctcctcatcctctactcctaagatctccaactcataaaaatgaatagaaaagaacatgtggccatcatattattgccacaagtgtgtgaataccaacttttgtctctcaagtaaagaagtgacctgcaacattttcaagctaatagaatttctagaccagtgattctcaaggatggggtaggttctaccacctcttaggatacatttgggaaaatccttgttgctgttgtaagcagcgttgccttctgtgaccttacgccaaaaatcatgcagcttcatgtttattgacttatattgattacaagtgagtcatgaagaccattccagattcaaggatgggacataggcccttctctccatgggaggtgtgtcaaagaatttgcagatgtggctgtatagtattccatggtgtatatttgccacattttctttcttttattttttttctttcttagtatttctttttttattattattatacttcaagttttagggtacatgtgcacaacgtgcaggtttgttacatatgtatacatgtgccatgttggtgtgctgcacccatgaactcgtcatgtagcattaggtatatctcctaatgctatccctcccccctccccccaccccacaacaggccccggtgtgtgatgttccccttcctgtgtccatgtgttctcattgttcaattcctacctatgagtgagaacatgtggtgtttggttttttgtctttgcgatagtttgctgagaatgatggtttccagcttcatccatgtccctacaaaggacacgacctcatcattttttatggctgcatagtattccatggtgtatatggtgccacattttcttaatccagtctatcattgatggacatttggattggttccaagtctttgctgttgtgaacagtgccacaataaacatatgtgtgcatgtgtctttatagtaacatgatttaaaatcctgttggtatatacccagtaatgggattgctgggtcaaatggtatttctagttctaggtcattgaggaatcgccacactgtcttccacaatggttgaactagtttacactcccaccaacagtgtaaaagtgttcctatttctccacatcctctccagcgcctgttgtttcctgactttttaatgatcgccattctaactggtgtgagatggtagttcctgtcctttgtagggacatggatgaaactggaaaccatcattctgagcaaactatcgcaaggacagaaaaccaaacaccgcatgttgtcactcataggtgggaattgaacaatgagaacacctggacacagggtggggaacttcacacaccagggcctgttgtggtgtgtggggaggggggaggaagagcattaggagaaatacctaatgtaaatgatgagttaatgggtgcagcacaccaacatggcacatgtatacatatgtaacaaacctgcatgttgtgcacatgtaccctagaacttaaagtataataaaaaaaaggaagagaaaaaaagaatttgcagacgtgttttaaaactaccacactactcaatctaaaattactcctaccctcaaccttcataatcgctctctcctgacttataatttttttaacaaatctcttaatattatctaacataccatttgcctaggctgggcattttaaaagacattaaaacagtatctggcacaaagaaggcattcaacaatatttgttgaatgaatgaatgaatttcactacattaacttgtaatatctcagtgctacttttgtagttgtttcaagttttctgctgatagctgctctaataatgctgctggcagaataaacaaacttggtaaatttgatcaaaataacttagtcataaacttggataattaaatccaaatttttttcctgttaaattggaaattatttgcctcttaatcgaagtagggcttcatcccttattgattcatatttgtgtcatccactgagtcgtaaaatgctgagttgacccctaataaaaataccttatccccttccctctgtaaaccagagaaataaacaaatttagaaacgtttcaaagaaggaaaatagaagacaagttagagttgtgctcattgtttagttgaagcaacataagttacattgtaaaagattaatgcaaaatgatcttcaaaactgagaccatagtatcacaaaagtcagttgaaccactttgccagaggttatttccagtcatttcaatcagtatttctgaatttcagtcgtgctgctaccactgtcaagctatagcaagtaagttgtccagacctgcatattttaacttgactaagttagaacaaaaagcactttctattattgcacagatgcctatgtacttgggaaaatgtgaagaatttaggtgactaggtgaatctataaagtgaagaatgttttgtgtgcagacaaagacacacatacctgggatttagtaagattctgccactttttatccgtaaaatatgtgataatgaaacttaacctctgtgagcttttgtttcctcatctgtaagatgcccgtcatgataccttcctttgtgatggttaggtgaataatgaacataaagcctgttagtaaacaacttggcaaatggtaacactcaatacacagtaactgtcatgattaatgataggaagtttcttttttttttttttaaataaaaagatggtattatttcccaaaatattcagataaatgaagcaaaattggttttgataatttacatgttcttataatgaccatcatctcctgctttccttttactatagagaaacagttgtgattaagaaatgtggacataagctgaggacccagacttcccaagtctgatgttactatcacaacctcactaggccattttgtatcaggaacaagctataggtttgggaaaatgaaaggggttcctgctattatttcttgaccaaagatatcagcaccgtcctgcagatattttcaaattcattttctcatcattctaaccacagggataatgtggattgtttcactgaaagaaaactgtagggctttaccctgctgtgagtacttatgttttttagactttatgggaatatgtacagtcatggagtttaaatctcccttgagtcatttgtttgtctgccttggcatactctgtgctggtattttccagctgcatactagtgagctgagtgatgagggaagaagcttgcccagggaagacataatggctcgactccacagctatgtgacactaacacctgaatcgattatgtctggttaataagtccttcccttcttgcatgactaagttttgacactaaacatatacctacatttaatcaaatccccttttttaaatgcaaagataaagaggtttaatcactcctttgctataaaaaagcatttcaagttattttactgctcaaatagaaatgaaactgaaaaaagctttatccagatttaaattttctagtattccccccaaaaatgtgtgtgtcctagaataacacaattctgatttagttttataaacctaccttttttacatggaccatgtgcaagtttgaaagaacaaggcttgcaggatagctcaggagtctggagaacacaggttattttgtttatttgtttgttttgagacaggtcttgctctgtcacccaggctggagtgcagtagtgcaatcatggctcactggaatctcgacctccctgcctcaagtgaccctcccgcctcagcttcctgagtagctgggactacaggcacgcaccaccacacctggcttatttttacatttttgaacagacgggtctcactatgttgcccaggctggtctcgaactcccgggctcaagcgatccttccatctcggcctcccaaagtgccggtattacaggcatgagccaccacacctggccaagaacacaggttaaaagtggatttgaggtcaagggccatcaagtttattttactcaagtcactttctctacaaacatatcaatactaaaagagctaatatgagagagtttaagactataaaagaagattctattttgttttccttaatgctagaaaaaccacaaatacagaacgatgagatagttcatctctaaaacctgaggatatagtgcattttctttccagctagttttatgtgttgctctgtattaatcaggttttccttatggccttaaaatacagaaccaaattctcagagtctcacattagtacaacctgatactaaagtatgggtaacacatcagctcaaaattaaaccataggcatttattatttattcataattctgttatgtaaataaaaatccactactgtttttgtttctttccggcagtagtactttcttacatggtttataagaaatattaaaaagaacaagttatttcattgagaaataccttgaccatttcatccatgatccaagaccatcacacttccctgtatttccactgtttaactgagcagtaatttagcttctcattaacggataacttgacattttctgtttctaagagttggtattttcaactcttcacatatctgcatctatcatttgtacaggcatatcttggaaatattgtaggttaggttccccactgcagtaaaacaaatatagcaaataagtcacacaaagttcttggtttcccagtgcatataaaagttatgtttacagtatactacagtgttaagtgtgcaatagcattatgtcattaaaaatgtacaaaccttaatttaaaaatactttattgctaaaaaaaatacaatcatctgagccttcagcaagtggtaatctttttggcggttgtggatcttgcctcagtgttgatgactgttgactcataagggtggtggttgctgaaagttggggaagctgtgggaatttcttaaaataagacaacagttaagtgtgtcacattgattgactctttcataaaatatttccctgtatatgatgctgtttgatagcattttacccacagtagaacttctttcaaaattatagttctctccaaccttgtggctgccttatcaactaagttaatgtaatattataaatcctttgttttcatttcaacaatattcacagcatcttcaccaggagtagattctttctcaataaatcactttctttgctcatccataagaagcaattcctcatctgttcaacttctttcatgaggttgcagcatttcagccacatcttcaggctccacctcttgctatttccatcacatctgcagtgacttcctccactgaagtcttcaacccctcaaagtcatccatgagggctggaatcaacttcttccaaactcctgttaatagtgatactttgtccttctcccatgaatcatgaatgttctttacggcacccggaatggtgaatcttttccagaagattttcaatttgctttgcccagatccatcagagaaatcactatttatggcagctatagctttacaaaatatatttattaaataagacttgaaagtcgaagttacttcttgatccatgtgctgcagaatagatgttgcattagcagatgtgaaaacatcattaatctccttgtacatctccatcagagttcttgggtgatcaaatgcattgccagtgagcagtgacattttgaaaggaatctttttttttctttttcccagagcagtaagtctcaacagtgggcttaaaatactcagtaaatcatgccataaacagataggctatcatctgggcttttttcttccatttacagagcacagacagtggagttagcataattcttaagagctgtagaattttggaatggtcaatgagcattggcttcaacttaaagttaccagctgccttggactcttacaaaagagtcagcctgtcctctgaagctttgaaaccaggcattctcaacttctctatgaaagtcttagatggcatcttcttatataagtctgtttcatctccattgaaaatctgttgtttagtgtagccaccttcaccaatgatctcagctagatcttctggataacttgctgcagcttctacaacagcacgtgctgcctcaccttgcacttctatgttatggagagggctcctttccttaaacgtcgcgaacaaacctgtactgacttccaactcttctcctgaagcctcctcacctctctgagccttcaatgaattgaagagagttagggccttgctctggattaggctttggcttaaggaagtgttgtggctggtttgatctatgcagaccactcacaatttctccatattagcagttaggctgctttgctttcttatcactggtgtgttccctgaagtggcactttcaatttccttcaagaacttttcctttgcattcataacttggcaaactgtttggcacaagaatcccagctttcagccttcctcggctttcaacctgccttcctcatgaagcttaatcatttctagttttttatttaaagtgagagacgtgactcttcctttcacttgaacatttagaggttgttgtagggttattaattgctctaatttcaatgttgctttatctccgggaatagagaggcctgaggagagggagagagacaaagagtggtggagcagagagaacatatatgacattgattaagtttgccatcttatatgggtgcagttcatggtaccccaaaacaattacaatagtaacatcaaacatcacttattacagatcatcgtaatagatataatgaaaaagtttgaaatattatgagaattaccaaaatgtgacacagagacatgaagtgagtacatgttattggaaaaatggtgccaataaacttgcttgacacagggttgtcacagaccttcaatttgtgtaacatgcaatatctacaaagtacaataaagtgaagtgcagtaaaacgaggtgtgtctgtctgtttttttggttgacatatacataactggatgaataattgatcacttctttggctcatgtaatgcagattggttttgtagctacatcattgcactacaaagtaactttggaaaataattttactaaagaaacttgtttcagagtctaattacatctattatctgcttctatagatatgctttatttttccttaacccacgttatacacataagtcaggaacaaagtaaaactacctttaggttttgaaaccttttatgtgggcttgaatttcaagcagaaattaaagtgtgggggcataatcactgaaccattgaaagagtgggttttccccctcctccttgacaaacataggtaatactttaccagggacaaaaaatatgcagcaaaattcagtgggggatacatttacataatgcatcttttaacgagggactgaatgagggcacatgtgacaatgctagcctgatgttctctccctcctgtcagttattctggagccaccctgcagtttaagctttaggtcaataaaatgaatttcaaagcaaaagccttcagcaccatggaggaattaactctgtagggttgcttcaaaaaaagcaatgaattttctattgcgtttacctaatgcaatagtatgttttttcaatttttgtcctttatcagaaaggcattttattcacatttaattccatttcttgatcagaattcatttctagaaacaaatacttctttttttaaatatagtaaaaattgggaacttaaattgcaattttaaaagtaaagtatacataatgaatccttatcaaatattttcaagtaactgttttgggttgaacatcccaatattttgtatatttatttccaatgttctatgtcatgcaatatgctacttcccacactgaaagaaatagagttaattttccacacataggaatcggggtttaaactgactcttcagttgttgagaataatctgaaaccatcttgttatctttcttcaacaaattcattttttaaatcataccacaaaaaatgtgcaaaccaatcacttccatttttctttcacttacagtagggtcagcaaaatttttcttaacttttttattttaggccaggcatggtggctattttagaacagtctttatatgtttacagagaaattgtgaagagaatacagaaagtttctatatattaggcacccagtttcccctgttattaacatattatgttactgtggtacatttgttacaattttgaaccaatattgatgcattattataaactgaagtccatagttcattcaattatttatcatttttttagtttttatttttatttttttgtagagacagggtctcactatgttgcccaggcgctggttcttgaactcctgggctcaagtgatcctcccatctcgtcctcccaaaaagctgggattatagatgggagccactgtgcctagattcattcaatttttttagtttgtgcctactgtctctttttggctccaggatcctatccaggataccacattacatttagttggcatttatctccttaagattctcttttttgtgacagtttctcacattctcatgtttttgatgaccttgagaatattgacaattactgaccaggtattttgtataatgtccctcaatttgagtttgtttaatgttttcttattatttgactggggttgcaggttttggggaagaagaccacagaggtaaagtaccattttcaccatatcatatcatgagtatatactattaatatgactcatttttaatgttgattctttattacctggctaaggcagcgtttgttaggtttatccactctaaagttacccttttttccctatttctataatgtgatttttggaaggaagtcaatatttgtagcccacacctatggagtgggaggtaagctacataaattgagggcagaatatctagataaattatttggaattcttctccacttagttacttctctttgtctcttctccacttactccattatttatttatatcagtatggactcatgcatgtttatattatatctaatactactttattatttattcatttgctgaaattgttccggtcttggccattggaagctctttcagtaggctcctatgtccctttgatatattcaattcttgtgggttgttttttttttcttgaatacttgctttctttctggagctataagatgctccagtctcataatatttacttcctaacccagtcctagctagaatcagccatttctccaagatgctctggttccttttattagacaatgtattagaaaccaagagctggatgttagtgctactgaggtatcattgcttgtatgccctcatagctggaagagtaaggaaatattatgtgtgtatcctaatctgggattatacacatatctataacttgtatatgtaatcctatatatctatattagcctgaacatgagtttatacttatgcttctagctctattaccatgaaaatcattctagcctcctcttcttgccttggcaggagtgagccaccgcacccagctgcctttattatccctttcttgtccatagtatcagtaatgatgattcttcattcatttataacattgacggtttattgagttctcactttttttcttggttagcctgaagagatttatcaacattttcatcttttcaaagaattagcttttggtttccttgatattctctattgtttgcctgtttttcaatttaagttatttctgctttaatttttattattttcctctgcttgcttctggcttaaattgctcttctttctccaatttcttaaaagcttacttaaattgttgattttaaatattcattttttaaaatgtattcaattagtgccataaatttctctctgagcactgcttttgtttcatcccacaaattttggtaagatgtattttcattttttagttcaaagtagtttttaatttctttcaagtcttctttcacctatgtagtattgagaaatgtctttagttttctgatagttgaagattttacagctatctttttgctattgatttctagttcagttcatggtctgtgtaatacaacctagaatgtgatctcaattttaagtttgttaatgtgtgttttatggtctcagatgtggtctgtttcggtaaggctttataaaaatatgtgttctgctgctgttgagtattttataaataccaatttgatcaagttgattgatcgtgttctttacatcaacctatccttacctattttctgcctgcttgacttagcaatttctgacgggaaggtgttgagctctccaactataaattggattcctctatttcttttttagtttttgccacgtgtatttctacagtctcttgctaggtgcacatgtgtttagtgttactacatcttcagggagaatttactcctttagtggttctctttactcctgataattatttatactgaagttggctttatctgaagttaatgtagccactccagcttattaaaattagtgttagcatgatatatctttctccatcccgttatttttaatctatgtgtctacatttaaagtgaggttcttgtagacaacatatagttgagtcttttaacaatatctgttttgacaatttcctttaatttgtgtatttatctcatttgcataatatatcaatgatacatcattacacaattaatatctaccatgtttgtaactgctttctattgattacatttgttttttttctttttttgcctcttattcttctttccctggttttaactgagcatgagaagaaagaacagagcagaagaaatatttcaagtaataaggtgaagataaaattccattttatctacattcttaacacataaattatacttattttttataattttttagtggtcattctagagttttatatatgtgtgtgtgaataatatatatatctaattaatatgaatccactttcctaaaacactatactgctccaggtgtagtacaattatgttataactgagttttctcaattcttccctcccatctcttataacgttgctgtcattcagttgacttatatacgtgctttaatcacctaacacattgttactattattacattaaacagagttacatttcagttcaatagtgactaagaacaataaaatattttgttttgcttttatctgttccttccctgaccctcttcctttccttacaaatacccaagtttctgatctctatcattttccttctccctggtgaactcgttttaacatttcttgcaagacaggtctgctggtgatgaaccctctgaatcattgtctaagaaagtctttatttctctttcactttgaaggataattttactggatttaaatactggtttgatgttctttctcttaacattttaaatattttactctactcttttctcgattgcacagtttatgacaagaagtatgctgtaattctcatctttgtttcctctgtagataaggtgtattttccctttgttttttttttttaatttctttggttttctgcagtttgagtgtgacataatgaggtaatatttttggtattcgtcctgcttggtgttctctgagctccctggatccatgatttggtttctgccattaattttggaaagttcttggccttattacttgaaatatttctttttctctgttctatcttgtcatcttagtttcttaattacacatatactacacacttaaatcgtctcacaattcttgaatattcttttatgttttttcatttgttttctctttgaatttccatttaggaaatttctattgacttatcttcaagctcattgattgtctactcagccatgtcaaagaaagactttctttattcccagcacagtcctctttcttttttttatttctattattttccatttattctttcgtagagtttccagctctttgctcatgttacacatgtttttgcatgttgtctacttttttcattaaaacacttcatatattctagttgttttaaatcccctgtctgataattccaacatctatgtcatatctggatgtagttctagtatttgcctatattcttcagataatttttttcttgcttttgagaatgccttctaattttttattaaaaattgtatataatctattgaataatagaaactgagagaaataggtctttggttcaatgttttatgttaatctcgctaggagtggggctgtgcttaacatttactgcagctgtatgtgcctgatgattcaaaatcctcttgtgtccttgtttttgtctctcctgttgactttgggcttccctacctactccttctcagagcgagtctgtgccttgcagctctttcagctgtgacccactgttgttacactgaattcctgttgtgagtggtggtaaggggtggggaaagggaagcattctattgccttatgattaaatttcaatttttactgaacctacgtccctaggttgtgactttcaaaagcatttcttaacttacttgtcttgggtgagaaaggaaggctagagatagctggagtgggagaatggccttcccctttttgggtcagggctctggtacagtcttttctcctgcacagtcaatctttgttgtgaagaacactctgggcatatttaattaaggttactcttcctctccccgtgccggagcctcaagggcatgtttctcagctcttcacactgggagaatttctggaagtaaaattcgtgaaaatgtgggggtcccctaaaatccaagtattttcttactgtcatgctagttcatactaaggctccagcaattagtcaagattaccatttagctgtttctactaccagttaatgtcccattggcttctgctgtaggtaaagaaatcttgactgtgactatttccattcacctgtctctcaagattttgaaatggtagtttgcattttgacctcggttatctgacgggttcatgaaaaattgttgactttcagtatactcagctaaaaggacaggagttgtaaggacaggtgtgacaacttccaaaatttttacattttagatctgaaactagaattctccacatagtttttctgtaaatggctatatagtaaatgttttcagatttgtattcagagtcatatagtctattttgcaactgctcaactctgttgtagtgccaaagcaaccagagataatatgtaaataaatgactgtggtggtgatgttctaatagaactctattgacaaaaacagagaattggctggatttggcctgagaggcatactttgctgatctctggtttaaagcatagatgaaaaatcctgaaagccagaaatcagttgagtctaatttattgaatggatcaataagtgaatgaaccagtctgcatgttaaaaatgtcttgaagagatttgatgatgctgcaaatatgcttctctcttaaaactatcaaataagaaagtttcaatcactgtatacacttttgctgttacagtcttagtcacagaatttactatatgtacccaatttcaaatggaaagaggaaaacgttacttcattttctcttgaaattacatttattctctactttgccaaagaataatatttgggtctaaataatataaagcaaacaatgagctatttctcttcattacaattcaaaagtgataattttccaatgcctgaagtaagaaatgtaataaaatcttaagcacttgggattcagctaagtgtatccttaaataaatcagcacctaacaaaataagaggccttcacggtgttaaagaattaaagcttcacaggataaaagaagaaaacagcagtatctaacctcatgaatttaaactgtttgaagtagaagagttatgggagtgaaaagcatacattttagtgactatgataacataacaggtttaaagaatgagttaaccaatttagaattttcattacctaagttaaaactgtctaatgcctacagtaaaaatgcaatattttcaggaaattattcatggaatacattttctaaaaacccataaggtgaagatgctgccccatgaaatatgtaaaacagtattcccaaacatttcccattctgaatctacaaatttctcctcaaattgcaaattaggaacagacagaactgatctcctcaggtgaatagtatttaactaaaatattttatggatgcaatgagtttgctgtctgccagctttttagacttggatctcactttgatttattgttctctggcttctgggagctaatctatctttgctgagattgcctaaatcctctcttacttattcattacctcaacaattagttctagttactaacctatataaaggtagatgacagtgtaagtcagcaaatgaatatctgctgtctgtctcgctgaggctgggtggttcacttcaatgactactgtcactttttatccaagttagggtaatagaggcacacaggatagcagtaactgagtttcagaattcagtgtctagcagaccaaaattagatattttgcccttttatttcaatggcttatcatttaaattatgaaattttcagtcttgtacattcttgttaagaataatctttatgggccacacgtggtagctcacgcctgtaatcccagcactttgggaggccgaggtgggcaggcgacatcaggagtttgacaccagcctgaccaacatggagaaaccctgtctctactaaaaatacaaaattagctggacgtggtggcgcatgcctgtaatcctagttactcaggaggctgaggcaggagaatcacttgaacctgggaggtggaggttgccatgagctgagatcgtgccattgcactccagcctgggcaacaagagcgaaattccgtctcaaaaaacaaagaataatctttatttaaattatgtctttttattattaatgtgaatgagctctgccttcccactactttttgtaattgttaatgctggtatgtaggtaagattttaaatgtatatctagaattatttttatcattagtaaactttcatattaatttgtattagtttcctccatagacaatcattattggtgtcaatgaaacatgggatgtctggaggaagtgacaagagatgaagttggacaggatgttggatccatagcagccatgttttaatacatgactccatctccctggctacagttggctaagccatgtatagatactttacaaatgctgagtcagttactctctttcttgggattttagaattggagcaaacagcaaaatattctctgccagcatatacagctataatatataaactacagagccttgtggcagtcatattgaaaataatattctgcagaatggaaaatagagacagaccttccgagaaaagaaaggagaaataggaagctctgccttctgtccaggtctttccaaagctgactacattcctacccttgagctccaggaaacacctctgtacccttaaaacatattcttccattttacttacacctggtttgatttggttctgttacttgtaaccaaaataatctaagataatatgccttatgattatcacagcatattcaccaaactctattataattatttacctccccatagaaactattaaaagatgtgactataatttaattttttacatagccctagtattgagtcagcactaaataaattaactgcaaagcaatgaaagagaaaagcttgtctgagtgggagacacagcatgataaagcttgctacaacagccgttccttctcaagtggaaatgtttatgaactattgttttctttttattatactttaagttctggggtacatgtgcagaacttgcagttttgttacataggtatacacgtgccatggcagtttgctgcacccatcaacccatcacctacattaggtatttctcctaatgctatccctccactagtcccccatcccctgacaggccccggtgtgtgatgttcccctccctgtgtccatgtgttctcatcgttcaactcccatttatgagtgagaacacgcattgtttgattttctgttcttgtgttagtttgctgagaatgatggcttccagcttcatccatgtccctgcaaaggacgtgaactcatcctttttatggctgcatagtattcaatggtgtatatgtgccacattttctttatccagtctgtcattgatgggcatttgagttgattccaagtctttgtcattgtgaatagtgccacagtaaacatacgtgtgcatgtgtctttatagtagaatgatttataatcctttgggtatatacccagtaatgggattgctgggtcatatggtatttctggttctagatccttgaggaatcgcgacactgtttaaaaacaaaacaaaacaaacaaacacttagaagaggttttcacaaactgcatttgatggttgcccactggctcaagatgggaacaagtgttcagtgcaaaacggtttcacagtagttacatatttttaaatccctttttttaatagagttagcaattttctttacagtaatagtactcagagcatttaatatgatataggtgcactgcagatcttcaggaaggtgataaaacaatcatggtttcccaaactctttgaccatgtgattcttttaccacaaaacttcacaaaactcaagtcaacaatgacaaaaccccccaaacaacccaagttttctaatggacaaagaacttgaatagacatttctcaaaaaaatcaaaagatatacacatggcaaacagacacatgagaaaacgcttaacatcactaatcacaaaaatacaacagtgaataccacaacatacccattaggatggctactattaaaaagtaaatagcaaagaagtgaataaattagaatcgttgcatactgttggtaggaaagcaaaatgatgtagctgctatggaaaacagtatggaagtacctcaaaaaaattaaacatagaattaccaaatgatccagcaatttcacttcaatgcaatattattcagccttaaaaatgaagttctgcgacattctatagcatggaagcatggataaaccttgaagacattacgctaagggaaatgagctagtcacagaaatgctaatattgtattatcccacttatatgaagtatgtagagtagtaaaattcatgaagtcaggaaatagaacatagttgccagaggctggggggtagggggaaatggggagatgttgtttgatgtatacaggatttttgttttacaagatgagacgagttctggagattggttacacaacgatgcgaatatatttaacactattgaactgtacatgtaaaaaaaggttacaatagtaaatttgatgttatgtgtattttaccacagttgaaaattaaaaaaaaaaaaagatcagtatcctcggaaaaaatacttatagaaacaatgccaagacaattccatggtgtgctgctcccagagtacatgcatggaggagtaaagccactccttcactaaaaaaaagtgatggttaagttattttctgtgcaatttctagcatagcaaattgcagtaatcagtgttacttcttacttgagagtgggtaaaaatcacccagttaccttttatttcctgatgaataactattaatattgtattactctgttgtcctctgctttccattttaaatagtgtcagagaataaggacatggagagaaggttcagggctgataaaacaaccatctacctctacctactcccccaatttagtagcctcaacacaagattagtagcccccagaagacctctaggggcaactgtagacttctaaggatctttctccatagtgggtaaggtactaactaccaaggtttagtgggatttatctaatctgagaaaagtcttctaaatttccaaagtttccctttcatttctgatcatatagtgtaagagacaataaaaacttataatcctaccactgccacttcctagcttccattccatcacataatttttcagtgtctgttgtcctctctgaaacctggggccagtatcagagcagccttcttgaagccatcctgaagagtaatgaatagaaatgagttataaatataaaatgctgtataaatcttttagcaccagagacttgagatgttttaaatacacaaaggacagactaataagactatcaatcctgtctccaatgtatagacatttagaaagtgggataccatccatctctgactcttaaagcctcagtttaaaaaaatctatgatttccatcaatgtagagaaacgtgcccttttgccttcctttctggagctaatataatgaattttcctgtatatacaaagttcatgtgagattacattttatctgcaatgtagctttctagacgcattatgaacagttttcttaattcagagagggttcgattctacattcctttgctagcattggtctatattgggggcatcaaattgagtgaatattaatgatgagattatttgcatattatatggctaacatactgaaaaaagaacaattttaaaagaatcaagggtggcagttttaaaaccttaatgggctgctattttcaactgtggttgttttgtttgtttttttttaagagttgaggtcttgctctgtttctctggctggagtgcagtggtgcaatcatagctcaatggagctttgaattctttggctgaagcaatgcttccacctcagcctcccaaggagctgggacaacaggccgtgcctggctaatgtttttattctttgcagagactgggtcttgctatgttgcccaggtggtcttgaactactagcctcgagtgatccttccacctcagcctcccagagctctgggattacaggcgtgagccaccacactcagttgtattgagttttaatattaaataagttggtcttcattgaggacccaatattttaaattacatttcactgggggttctgaaaatatccataagtttgactgtcgatttgttgttgaagtaataactctcaacggtgcccaattccatttatgtgatttttcaaaacaatctattagcttttatccaccaaaatatgacttgtaaataagaaatccatgttaaagagaaatgtgtgcttatgtacacacattaagattaagatcctttgcacagaaccttctgccatagagttataagaaagaaaaccatttagtcagaagtcctgaaaccaaaacaacctgcatagtctattaaaagaaagatgtgttggtccgatcagctggatcaaccatgctgatgcagtgctttggtaatttgtcttcaatgtccggcaccatttttttgaggaaataatggaaagaagatgtatgtccctgcaagcctagtccctctagcaacattggtcccactccaaataaatcttcctctccacctgccattcttatgctgctctggattcctagaggaaatgtttcagcagtttaggaacataggacagcattagagacatttttctcttcattttcctttatgagcctgagaaacagtgttcctacaaccttcttaggtgtaaaagaaataataaagtagaccagccttctttattttttaaactgtgtatcaaaattgagctaataaaactctttccagaaggattaaatattcctgactttcactttccttttctttctcgcagtccccctttcccctgggactactttactcaacatgagatatgcgcaaaggtacataatatagacagaacattggctgcatttaaggaaaagacttcagagaagccatcattttacagattagcaaacttatcctcagttatcaagtaacttctccaaggccaggttgagccaccttctcaattgaatcaaatccatttgtttctgtatattcataagcacatccaacaaaggccacataaaaacttaaaacattgttaaatcctcagcttctttatcagaaagacagctagatactcctttgttgaacattatcagaggccattttgagtgaaatatatcttgtattatttccccatctcagcattaccacccaggttgatgaaactatccaatccccaataatttttcttcatcagtgactattcttcaaaacagcaagtcgtcttgttataatttcaaaccaaagatcttatgaaaagaccagctccttctctacagagatggattacatcaggagcaatagcagataaactctgacctctagatctgaaagaagaatttcagtgataactgtaaaaatattttcagttattaatacataagaaaacacatcatttgtatttacggatcatcactgccatttatagttatgatgttcttctctctagtgatttttaactggaaaggggtaaatggaaatgtgtagacaaacacattcaaaagaaaccctacttctgagcccttctaaagattttactgggtagtctttaagacaaaagtttcttttataaaaggcaaaaaatcaacttcaaaactcaggcttcaaatcatcaagggttactttctcctcttctaactagattaaacttttggagtcccagcaaaagggacttatcatatcccatttggcaagaactagtcccctataattacagattgaaagtgttttctaggcttcatacatttgtccagaaaatgggcagtttaaggaatcataatgaggcatcattcaatgggagaaaggacttcacctgaaattcaagcctttgtggcttctctcagacatctggctctttctcactttttgtggtcagggcaaaatcaattattcgatgacctgggcatagatatggttctctctagtttcaaggagggaagaatgccagaaccacaagcactctcatgtgaaaggctgtgcttgatgcgtttatcatagaagtttgatgatgtctgagggcacggatgccaggagttttgttttgttttttaatttaattatgctgttaaaagcatttttctttccataagcccctatactgcctttgaaaatattcattctccggagtcatccaagaggagggagaacagtatgagctttgagctgaacagaagactctccctcctctggctggtgggaggtgactctctgagtgcctcatatgttcaaacttgaattaattccactcacactatacccccacaggtaatgaagacaaatagtgctgcagtctttgggtacagtttcaatgtttacttctggtaacaaccaaggatatattgctcagactctggaaactacaaaaatcattttggagaagaaaattttgactctctacctcctcgttctttgccacgaaggagaaagaccacagtaatagttaaggcagctgaaacaagaaagggtgcacaaaacccggattcccccttcatctaacttcagacaccctattatgtagagttaattgcaactgttacttatcaagcatagcagatccccacacctcctccccattggtatcccctcaggccttactatttcagtaccctactcactccagcatctgcctctctttgcctttgggctttcttcagccttaggatcctcactgcttctattcccctacacaagtaagaggccaggaatgccaggaaataaatgcctccccatgagaacagcctttgaccgatgactgatggaagctggtataaataccttagtgcccttgtccctcaggtgggataactattgtcctactctgagtccctcgggtccccagtggaattaagctccagttgaccacagtaataacaacacagtctttattggctggattccctttttgcttttacttccccacaacctaaataaaaggctcacacttgaatctatggctatgggtctgtttttaagacacaaagtgttgaggtgtggactttaaaggaagaggacaagctgttttgctagatgagattcagatacataaagtccatccttttctctacacctctgatagatgttagccttttgtaatggcttttccccttgtggttacacatacataaaagctcatgaaactttaacccttatcacttctcctcacttcccccataaagcagtggggctgataatcaaatcatgatttcacacagttcctgacttccagagctcttcaggctccccattgccaagatcagagtgaagatttggggttccagaggacaagtccttatccatgctgcccctaatttaatgtctctctcccatctttccaagggaggtcctgctcgcattagtgcctcttccacggactgctgagttgcctggctggctttctgccctgacatgagattgttccctaccttggatctctatttggttgtggtgacctcaaatctttcaatattttgcccagcatgcctcctcattatacctctagctcctggctaaggccgtcttcgttatgaacagagatattattaataatgtctgtaactttttctgttttctaaatttatttttaattgacagataaaatattgtgtatttaccatatcagtgtgacattttgaagtatatatacgttgtgaaatgattgactctaactaattagcatgtgcattacttcatgtagttattctgtggtaagaacactttacattcaccctcttagcatttttcaagaaaataatatattgttaaatttagtcaccatgttgcacaatagatttcttgaatttattcctcctatttgactgaaattttgtatgctttgaccaacatctcccctaaccaccattctgctttctacttctataagatcaacttttttagattccatatatgagtgagatcatgtggtgtttgtctttctgtgtctggcttacttcatttaacataatatcctcgaggctcatccctcttattgcaaatgacaggattgcttccttttttatggctgaatagtattccactgtgtctatataccatattttctttatccattcatccagggatgggcacttaggttgtttacatatcttggcttttgtgaatagtgctgtgataaatgtagaaatgcagatatctcttcagatgtctgtaatcttctttaaaatatttcagaatggactgtataatacagtattagttttactagaaggaacaatcagtgatcctaatcaggaatccatatcccaggaatgaggaggtaacaacaaaaaaaaagacgtagctgggcatggtggctcacacttgtaatccctgtcctttgggaggctgaggcaggtggattgagtgagctcaggatttgagaccagcctggccaacattgcaaaaccttatctctccaaaaaaacaaaacaaaacaaacaaacaaaaaacaggtatggtggtacacacctatagccccaactacttgggaggtaggatggcttgagcctaggagacacaggttgcagtgagccaagatcacaccattgtgctccagcctgggcagcagagtcagaccctgtctcaaaaaaaataaaaaaaaaaggaaagaaaagacactccagagatgactgttacaaatgtctctactttctttctctcccatcaacactagatatttctctaattagcataattaatagtagaagtaaagtttcattgacaaaatttatggcttgctagttagggtaagatatgtcagaaatgagattgtataggtgaaattagttatattcaagatgtatttattggctaaaatattttcaagaaatcacccatctttgaataaacagggtatgaaaatcaagcaagttgtctgtatttaccattagttttggcacattatgtttaaccctaaacccagagcccagcagttgttctgaaatatttttgatcacctctatagtggatggtttgtgaaatcccatcactacaatactactacatttgcctcagataaacattttatgaaaattccttgtgaagcaccagaaaagacagaattctaggatttctttggtttggaatcacatggctcttcttgcctgcttgtgtgtatagcagaatttgatctgagacttgtttttattaccaagttgcaggggatatgccaaccctcgcctacctctacatatttggtggtttctgagatctttcagaatgagcctatgagttgtgatgatcaaattgccttacaccatctccccctactccctgatcacagaatagtacagattttccattatacatgagactatcatgttgaatgctctggtgccaaccattttctacaatgacaactgatattctttcatctcattgggctgacctctttggtcccaactctggtcttgagcgagtcttccctaaccccaatcttgtcctgcatgatagctttggcactgttatggctagttccttaccattattggtatcagattcattctttgaatcatttattcgttcaacaactattaaacattttctatgtatcatacagtgttgtaaacccaggtgatatttcagtcaaaaaggcatacaagatcttgtgagtaaagatgagtaaaagagtgaacaaattaataagataatttcagatcgtaataagtactgtgaaaaaaatgataaaaaatgaaaaaaaaagggaattacagcaaggaattggctgttttggaaaggatgatcaagaaaagccacttagaaggataataagaggtatacttaagccaagatcttatagtgctttccactgagacttccagagttttaatagaattagtaatcagtgtgatttgcaatgaagggtggctctgaggtctctacaagttcatttttaaccttttaggaacagccagattgtcatcagtgtctgtacctcacctcatggctaatcaaaatgtgaaagaatcccttaaagaaccaagatccatttagctaccttgaagcaatataatgcacgattggcactttgacttttttcattgaactgatcagttggatcagtttgtataaactgattggtttagcattttgtagtccacaaatagacaaagaaaatcattcaaaacctagcttcacttgttagtactgatggagcaccaagaataataaaatctgagattgtttaatagaagggcctttagagatcagtgtacccaagaagaaaacaagttctgcaaaattaacccaaaaatgcacaccttgcacactgaacactctcatgtttattttactgctcactcataaaggtttttcaaagacccttggcgttgatatttcacttactgtaagatggtttgtcatgaactgtttttaattttttatatatgaaaatatgcgaacattaaaaatatgcatataaatcacccaccatatttacaaatggtccctgacttaacgatggttcaacataagattattcagctttacaatggtgggaaactgatatgcattcagtagaaaccatattttgaattttcatcttttctcaggctagcaatacatagtacgatactctttttccatgttgggcagtagcaacaagccacagccagtcagccatgtgatcaggataaacaaccaatactctacagtgttctgtgttgccagcatttttgcatattgtgttttgtattttcacatctcagataccaaaaatacccgtttttgacttatgatattttagactaatgatgggtttatcagaatgtaacactgtcctaagtcaaggagtgtctctatttacctttcatgtttggtgcataaaaatatttacattgttgtaaccatagaattcataaaatgtaatatattgctctgaaacctagcattatattttatgcctttcccatattgctatgtagtgtctttgttatatttaatggctttaaaatattccattgagcagttataccccaatttaattagctactctcctattttagctatttgaactgtttttaattttcattgttatttgaaaaatatgtaaatgcataagactgtttcagcatttggattacttccttaggctaaagtcccagaaggaaaattgctatagcaaagtatgtgaatagttctacatttctaaaaaaccagcgctgttactttctgtaaagtttttgctaatattcaaagtagcagtaataaaaaggagtatcagattcaaagtattcttatcaccattcaatagctttgcttttaaggctttattaagggggtaaaaaacattaccactttttgagaataaatttacttgttgaatttcctcttttgtgaattgtctgttcacatctttttcttgtttatttattgatcttagaattggtccatttgtttggacactttatagagatactcacccgcacacatttttgctgcaaatattttcccagatggctttttggcattcttttcctcttatagagtatacacaaaattatgtatctttttctttatgactattgctatctctccaatgcttgaaagtcagcatcttctgtgaaggttttgataaatgatcaacacaattcaatttcttccctttattagttagattttgttcctttatttatattagaagtttatttatgcgaaactcttcattcatagtgtgatatatgttcattttattgtccatttactaacgaattatcactactattattattattatatgtccttcttttgccatcttaaaaaggtaaaacgacttttcatttatatttaaatttatatacaatgttatatacattttaatagctttattgaggtataactggcatacaataaatcaagcatactttaaatgtaccaccattataatcaaaatgaatatatattgaataaatatatacaccactcccccaaagtttccctgtaccttctttaattctctcctccttgtcactcttcccttcccagcctctttctcctgtccccagccaaccagcagccactctagattagatggcattttgttagagttctggataaatggaatcatagaatattcctttttggtggggcttatgttactcagcgtaattattttgggatttatccatcatgtggtacatatcaatagttcatttattttattgctcagtagaattcccttggatgattatacccctgtttgtttatccattcagttatcgatggacatttgatttatttaaagttgttggctactacaaattaagctgttgggaatatccaggtgcatgtctttctatgaatgtatgctttcttttctcttaggtaaatatctaaaagtggcatggctgaattgtattgtcagtaggtatttgactttttaagaaactgccaaattgtttcccacaatggttgtctcattttacattcctaccagcggtgaaggagagttttagttcttccacatcttcactaacacttggtgtgctcagtctttctgatttttgccatattctaatgaatgcgtaatggtatctcattgtggctttagtttgcatttctcctaataactaatgatgttgagcatcttttcatctgcttatttgccatctgtgtctaaaagttgagaataattatgttctcttgatgaattgaccctgttatcattatgaaagaatcatctttttctagtaatattcttttctctgaaatattttatcttaatatagctactaggctttatttgattagtgttatcatggtatattttcccattcttttactgtgaacctatttgtgtctttgtacttacagtatgtttcttataggatcttcaatttttatcgattctaacaactctaaattttaattgaggcaattagaatatttttttattccttgttatctccttttttggatttattaacttataactgttttcttattttagtgattgctttagggttcgtgttatacatctttaacttatctgtacttaccttcaactgtatatcatatcaaatataaatgtatataccacctcacatgtagtataaacaccttcctatagtttatttatatttttcccctcctggtctgtgtgtgtgtgcacatgtgtgcacatgctgccacaatacattgttatgacttttaatatatttaagtctttttttattgtgggaaaatagacataatgtaaaattaccattttaaccatctctaagtgtacaattcaatggcattaagtacattcgcattgttgtgcaaccaccaccaccatccatctccaaaactttatcgcaccccaaactgaaatgctatacccattaaacaataactccccattcccctcaccctccagcccctggtagccactattttacttctgtctccatgaatttgaccactcgaggtacctcatgtaagcagaagcatacaatatttgttcttttgtgtctggcttatttcacttagcgcactattttcaagattcgtttatgtttcggcatgtatcaaaatttcattcatttttaaagctgaataatattccactgtatgtacatacccatgccacatgttgttcatctactcatccatcagtgttcatttgggttatttctaccttttggctattgagaataacgctgctatgaacactggtgcacaaatatctgctcaagttcctgctgtcaacacttttgagtagatatctagaagtagagttgctggagtttgtagtaattttctgaaaaacagttaatgatcttttgaaaggatttagatacaaatttaaattgtgatttaaatggtgatttgaattgaagatcttctatatttgctcatgtagttcacatttctggatctctgcattgttttgtgaaaatccttatttccaaatgtgtatttgtaaaggttaactatttgttttaacagttgaactttagaataaaatcatcaactttcagaaaaaaaactatttgggattaaggatttaattccaggtcatctaaaacataacttagaacaactagaaaatattcagtctttccatcccataatatgtcacagttttccacttatgcaggtcgtcttttcagtacaccagtgcaattttgcaattgtctttatttagcttctctacatcttttgttatgtttattctttatagtttttaagagcattatatttccattgaattgacctttttgaaattgttctatttcttttctgtgaatgtacagaatactattgacttctgcgtatcatatactgctcccttaattaaactttcattaagactaaagattgttatttttagctgaatgccttggatgtctacgtgtataatcttgccatttcataataatagcgtgtattattttcttttacatggcttgctgtattaataaacatttccaaaatgctactatataaaaacagtaaacatagatgtttgttattgttgttcctgagcttattctctagcaatgtgctattgacgataattatgacaggtttttgataagggctgtcaaaatatatatatacatgtatatatggaaaaatcttcaatccctttttaaaaatgcctttaaatgttcaattttagcaaatgcctttctgctgttagagtattatcaacataattatattactgcatgtccttatattttatcattcctgcattcctgagataagccctgctttactgtaacaggttattcttgtgttaaatcgttataatctctgtgttagtatcttctttaaggtgttagttaatgtgcattattggttttaaggtagcaaagaagcagagaatctcctgctactccacagctagtaatgagtgagaaaatccataagaattaaaagggtgatggcctcattaaacagcaaaggaaaagatattctttctagtatttttcttaccgtaaggccttagaggctgcattccttaaaatcatgattattagcatgatggctggcaaatacgaagtccaacttaaaaattggaaaattaggtaaagtattaataaaagaacattaaatccatttttaggactgcaacaggctcctctccaccctacccacatcaacctatcgatacagtctggatagagtagaaagcagtggcaagaacttgttttaaggcttcacaatatacattttcaactgtactgtctcaaaactaaggttcataaaatgactttattgagacgtttctctagaagtgaaaaactctaaacaatccctcctcttaattgataaagtgcaccttttcgtccatgttttcctatgactctgtgccatttttcttggaaacaagaaatgggggtgggtttgtgtttttttttttcttcatatcctcagggccaagtaaaaattaagaatcatagaaatacctgaataaattaagagaaaaattgaagaataataggtgtgtactagagttcagcataatgaggctcgaaacacagcatgacagcaggggaagcgattggcaagtaattttttgtcctatcaaataaaattaaatagggaaaaatacagttttctgtaccataactttaaccaattatatttagccagcacttgtgtccattttcttatactgataattcagggatgttttttataatccaaacatccctttggcaattgaaattgcagggataacatctcttttgttgacataaaccatgggaacttgagttgcatgatctcattatctgattacagctgtgactttgaagtaatctctcggaatgagtacctctttttgctaatagactttattttttttagagcaattttaggttcacagcaaaatggagaggaaagtacggagatttcccatatacctcctgcccccacacttgcaaactccaccattatcagcatcccccaccagaaagtacatttcttacagttgacgaacctgcattgatatatcattatcacccaagtccatagtttacattgggattcactcttggtgttgtacattcgatgggtttcgacgtataatgacatgtatctagcattatggtatcatatggaatagcttcgctgtcctaaaaattctctgcgatctatctgttcatttctcccttccccataatctctggcaaccactgatcattttactgtctccacagttttgccttttccagaatgtcacagttggaattgtacagtaggtagccttttcagactggcttctttcagacagtaatatggagtaagttttctccatgtcttttcatagcttgatagcagaatgtgtgctttgggaggagctgttgcttacaggccaagcccaggattatagaagaggatttgcaatgatattcattaacactgttattttgctgttggctttctcctgctttaccattagtgcttcatttagtttctcactggactagaaactacagtgggatttatttcaggtgtacatgcaaacagcactcagccaatattgctttcctaggtggtcaggggtagaacagcaatggactgcacggcacactgttctacaaggatcccatgtggagttcaatcctataaagtaatcttaagaggaattccagaacagtcgtgtgaaaatcactgtttcactcacatctttgaaagagtaactttttggctcttattaagtaacaacgtttgaagcaattatcctaggatccatggattttcactcttacttttaaacactggtctatgaaacttcatcaaaatctcccacaaagctatttctagcatcagcactatgcaggaaacgtgacctaaagtgctctctgttccacagcaaaggagaaggctagaagaacaagcagaactgtcccatgttggcaggctggtacccagaaatttccccaagggcaccagtgcaagaatatgactaagggagaaatgaaccacagctttgcagtacacgggatggcttgtgacctaaaacatcccccaaaactcagtgggcagacagattagcggccagacaggcactcatggaatcagtaaacttcagagacggaagccaaaagtgacagaagtttgccagtaatggggaaggctgacggctggaaggacaactggagacatagcacataggcaggctgatggccggaaggttctctagggggacagggcaaagaaaagactctggccaaaaggagtcacagttcttcagcatgtctgcaggtttgtgccccaagaaatagatgagggaaggcaggctagtgaccagatgggtcccagagcagcagcacactgcaggtgaggtgggcaaaacttcacccgtttccccagcaagggggaaggtcagtgagcttaagaacaaaagaaatccaggcatgcaggcaggctgatacctggaaagttctctggaggcactaattggaatgtaactggctcaagtccatgtgcttgccacttagaggctgaaaacataagaagccaggtgtggtaagaagcaaaagcaactttcttcaaatgttagcagttgaggaatggccaggttcatgactttaaaagatcattctagctttctgggctgagtgaaggggtttaagaatgaaaacgtggtctaggaaacttgcaggagtggtgtcaatggctatcttgagtaatcgcccatccatctggaggtctggtttggtagtggtggactaactgttcataactctccctaagtgggaggatttcacagctgggtctccatgcctggtttgtttcaaaattagcctctgaaatttcttttttcttttcttttcttttgagacagggtctcgctctgtcacctaggctggagtgcagtggcacgatctcagctctctgcaacctccgcctcctgggttcaagcagttctgcctcagcctcccaagtagctgggatcacaggcatgtgccaccatgcccagctaatttttgtattttcagtagagatggggtttcaccacattggccagactggtctccaactcctggcctcaggtgatctgccagtctcggactcccaaagtgctgggattacaggtgtgagccagtccccgaaacctctaagcaagtgcataattagataaatgagcactgtgcacggatgtgcctggtgggagagagagagaaacaaagagttttaaagtacaaggctacgttatgcaattaggaaggaaaggaaagaaaaaggtttcaaaatgcatttcaaggctgagatacttggttacaggaagatgtgatggtggctgaaagaaattaagattttccatcacgtggtcaagttgtggcaaaggatgacagcaacttctgcaagtggataggctatagaccagatgggcaccccacatcacccttctcccctccaaatcagcacactgcagcgaaggtgattgaaagtccccttccccaacaagggagaaggctggtgctgggaagctgaccagaaccttagcagcagggaaggcttatgcccagggcaccctcaataaggtattatggttgccaagaagagccatgtttcccaaaaacaccagcatggttatggcctaaagtatctcccacaacctaagcataccggtaggctggtgactggttggcccacgtggcatcagatcactggaagaaagggatctgaaaagtttccatttccccagctcaagggaagcttatggcctgaaggaccaccggaaaccagaaggtacctccagggcactaccttgaaggaactatgatgagcaaaaagagtcatagtttcccagcacatgggctggcctgtggagcaaagagtgacaggaatcccagcagccagactagtgacaagatgggctccccagacagcagcgctatgcaggaaagtggcctaaaatgctctcctattcagcagcaaaggggaagcctgatggcaagaaaaacacccagaaccatagcacttgttcaggttgctgcctggaagtttccccaggtggctgggggaaggataaggtggtggctaaaaggagccacaatttcccagcgcgcaggcaagctcgtggccccaaagaaacccaaaactgcatggggagagcaggttagggactggatggatgccagtgtcaacagtaccacagagatgaggtggctgaaacttcagttggttcctcagtaagcggaaaggttagtagccttaagaagaccagagccctagtcctagagcaaattggtgctaggaatgccaccaaggaacaatcatatataaatgacaaaggctgagaggaatctcccttcaccaggaacccagactaatttgtggctgtaagaatcctcccaactccagcagacgggtattctagtgattccgtgggccccaagtgcttcagcacagtgaaggaaaggtagccaaaatggtttcagttccacagcaagttggaaggctagtgggcaggaggagcctggaacccaagtgctagggaagtctagtggccaggaggaacttcaaggcactgatggtggctgaagggggcaggtattccccatactaaaatcaggccggtgcacacactcccatttcctgtgtgcccgtgaatatagagtcctgcatgtggccctgataactggcaagtagagggatgatggccagaaagccctcgagacctcgaaagggcagttggtgtgtgagcagaagattccactggtttgcaccatgagggtcatacggtagccaaaatgacttttgtttccccagcttagatagaggctgctgacggtctgaaggagtccataacctagtgtgcagacaggcaagttactcaaaggcctctgggcaccccctcattggagggaaggtagccaaaaatgcccttggctccccaacaagcaggatggcatgtggtcagaaggaataccaagacgctagcacatgggcaggtcaattcctggaatgtttcctggagcacccaacatgaggctataatggtggacaaaaggagtcacagttctctagcacttgggcagacttgtggcccaaagggtcccggaatcccagcaggcaggcaggaaaggattccagggccacagtgcatggggggacagatgacctaaagtgctgtcagttcctcagtgagtgggaaggctggaaccctagggtgcacaggcagagtggtgcctggaaggaccttcagagcaccatctgcaggcactgatggtgactaaagggagccaaattttcccaacttgtggcctgaaaggttcccggtttctcattctgccatacaaccagtgacccagagaactgactcatggccagaaggtccacccttaacttagtgggagcggaggctagtggctcagagggacctcagctctctgtgcttggtctggcaggtgactgaaagggcccctaggtctctatcacaaatacttaaggtagctcaaaggtcataggtcctcaacatgatggaaacgaaggattggtgtccttgagcagagcctggctggtagccaaaggggcccttggttccccaaaaggcagttttttagagttccgtgctccaacattttcactgatgtcacccatgtcaatgtttttaaggaagcctgccagagaattctgacatgcagcctgggtttgagaactggattaaatccttttgactcctgtcaaaaggtgtggcgaaaagtgtattccagtttctgctactctcccacataaattaagcagagaactccaggatctcaaaaaaggaaactaagccacctattcaagtagaggtatcaaagaaggaagaagtacatccacaatgcaattcccccaaaaggtcctctcttgagcattcttttgggagctattgtagctggtgatgattcttcttagactggagctcccattgcagattcatggaagaagccaaggtggtgactcagatctctattccactggtccattttcttcaagtttcttccatcaaaaatagagacatctttctcattgaactgttttactctgaatccattcaaaaagagtggagcaaggtttctcaacctggacactactgaaatgttgggtcagataattatttgttgggggtggggagtgggggcatcctgtgcattgtaggatgtttaatagcatcctgatttgtacgcattcagtgcctgtaacacttctccacaatgtgacaaccaaaaatgcatccagatgttgttgccaaatatccccctgggatccaagatcaccccctcctgagaactactggaatgcaaatatagttcttcagtttaaatgcttatctttttgtttgtttgtttttcctgaggcaaagcttagtaatagttttttttgttttttttttgagagggagagtctcgctgtgtcacccaggttggagtgcagtggcacgacctcagctcactgcaacctccacctccctggttcaagcgattctcctgcctcagcctcccaagcagctgagactacaggtgtgcgccaccatgcccagctaagttttatatttttagtagggatggggtttcaccatattggccaagctggtcttgaactcctgacctcatgatccacctgccttggcctcccaatgtgccgggattacaagcgtgagccactgtgcccagccaaaacttagtaatattaagaattaaaatgatactgaaatcagtgattgtggaccaatagaaactttgcttttttataatacagattatttagacttgaacacttgctctcctttcctcatctgtgagctccatatgggcaaggattatgtcatactcactactatatttcctgtccctagaagattcctgccacatcacagttaatcaatatgtgtttattgaatcaactggggccaggtctcaagggaagatctttataattatatatgctgtattctttgtttgctcagaactcttctcttagaaatggccacctattttccacatatataatagattctttaagtatacaggctatgtttaattcaacaaatagttacttagctatctgaatgtttcctcccctctaggtgcctgtattataaaacttgatatgaaatatggtttttgaaaagccataaactactgctaacaaatgccctagagaagtgtttctcatacttcaatgtgcagatgaatcacctggagaacttgttacaaattctgatttagcaggtctgaggtagggcctgagattcaacatatctactaacttcccaggtgatgccaatgcagattgaccatttttgaatagcagaaatctagagctacagatccactagacccatgcagctaatcacctttgaatttaagtaattaaatttaaataacatttaaaattcagttcctcagtcctactaaccacgtttcaagtactcaataaccgcatgtggctagtagctcctaggctagaaaacaaagttagagaatatttccatttttcacagatagttctgtaatgaatacatgaccatgtattgagtgattcaagaaagtctttgtggattctggctgcacctggaaatacgagtaggattgtgatagaataaacattcaatatggaaatactggaaggcgttttgtgcaccagcaataaatggggctctagattgaaagagaacaggtatttaaacctgcctcttacattatcaagtttgtaactctgggagacttaaactttcccagacttggtttactcagtgtaaaaatgtctgtcacaatgtaggcttggcagccctcatttttcttctcacaactggggtcgctcgatccctacttgtagtctcattcctgtccttcattaccaagcccagagttatgagtcactgaagcaattctggccccacatgttctttatttggaactatttaggaaacttccatcatgagtggtaaaatcccagagtttagatggagaaccttgaattccaaggctaaaaggtcagtctccattcgatagacaataagaagatgatgcttttgagcatattaatgtaaagagtgagctatgctttgggaagattagcaagagcatttagcataaattagtttttgagtaatataactcgataagaggttagagatgagaacagagaggttgatggggccacatcagcgacaagccttgcttgccttttgttaaggagtttgcacttttatcccatgggccgtggtaaagagctaaggaactcaaattggggacatacttatatccaggccatctgaagtgggaggagatatttgaagggaataaggttggaggcaggagggctactcagacactattgtaatagtcaaagaaaatgaagatgaagacctaaatgggggcagtaggtagtgggcaatggtggagttgaaggaagaggctgaagaaatttttatgaggcaaaaccagcaggatgtggtgattaaacaatgtggggaagtaaatggaggtaatgatctaaatctgatggttctatcttgggtgtctaccaactgccaaagtaaatacagtggaagaaagacgtttaggcataagacaatgagttcacctttgaaaatcttgagtttaaagtacgtgagggatattcaagtaggtgtaaggatccagtgaacgggtggaatttgggagaaagggcaagaccacagcctgagataaacacgtcccctgtgtgcagaaatatttaaagccgtgggaaaagactaaagcattcagagaaacccatgaagaggaaggttgtaaggatagatgcttgggaagcaatgacatttaagacctggtcagaagagaagcctataactgaaatgtaaaaggagtcatcacagagatgaagagaatcaagtttttagaggataacaatgataactagtgttagtacagaagaaaaatctagcattataaggtttaaaatatgtccactgtatgggttcctggtgtttttaggaagagtgcgtcagtggagtgatgacagtggatgtcttaatctctctagctgcagatgactgagatccagtgagggaccaagcagaggaatcagaaatggcagagggagagttacccaggagatggagtaacaggtagtactaggtgattgcatatgctgaggagtaattttatttttcacaacacgggagtttaatagaaatagatatatcacaaggtgggcctggatgtgagggaaagaacatgggtttggttttgtacactggaattttaatgtttcagaaggacatcagcaaagggatgcccaatgagcaattggacatgcagaattagaagtcgctgaaaagagtctgcctgaatttattaatttagatatgcttgacatggaagtgataatgaagctctaaggatgaatggcattgaccagtatatgaatatattgtgaaagaaagaatacgaggaggaagtttgaataatgatccctgaatcagtcaagatacaccaggttgctttaactaaaaagctatgaagtttcaatgatttaatacaacaaaatttgtttctcacttgtgcgatgttccatggagcctcaacaattctccagggtatctttcctccacaggggcctcagagaaccaggatgtgcttccatcttatggctgcaacatctcaacatctcaccaagaaaggagaagagagagttagagggtctcacagtgacttttaatttcttcagcctgtaagtgacagccatcagttccccctcacaatcttttgggtagaactcatcatatggccttgcctaactaaactttctgcctgctttttggatttggccaaagctaagcattggcaagaagttcacacatataatccttcagaaacctgggatgaagatgaaatctgaacatgagtgagaagtggtaatgtctaagacatccatttaataaattagaataagatcaagaaaaatgggagagggtagtatagcggcagaagagtgtgggctcaagagtgccaagaaagagggaatcacaaaaagagactattggcaaaatgctgcgaggacttcagaggaaggcctacaacttttggtcaatgaatttggcacctgtgaggttactgatgaactttgagacggtagtttctgtacactgatgaacccatggatgacaaacctcaagcctaaaccttttctccttcacttgatttggccaagatgaacattcccattcctggcttttcccctcatggaatgttattataggctactcagtaagaaggaaataaaagcgaattcaaggataaaattgggggggggggtgctcaagactcaagaatcaagaagatatgaaggaagggttactgagagtgttttagctaaaaccacgggacatacatgatttccagtttcagtcagcattctttcatgatttttctctagaaatattcagttacctatcagtaggaactaggaaagtatactgcctaccagaggctattccagtgattgagattgcgttagttttctaatgctgtgttaacaaaaatatttcaccttaaaacaccgtatacttactgtatcaatgtttctgtggatcaggattccaggcatggcttaactgagattgctgcttcagcgcctcactgggtttcaatcaagatgtctgccaggctcaaattctcatctgaagcctctgctggggaaaggtctgctcccaaggccactcacatttttggcataattcaattccttatagctgtaggatggaggccctctgctcctacagactgctcacaattacctgccctgcagaccagttcatagttcatagttcatatagcagtttacaacatggctgctcatctcttcaaagtgaaggagagagagagaaatagagaatggggaggagaaggagaaagagactagcaagacagagtcttatataaagtaactgtattagtccgttcttgcattactataaagaatacctgaaactgggtaatttatatagaaaagaggtttaattggctcacggttccataggctcaacaggaagcatggcttggaggcctcaggaaacttacaatcatggtggaaggcaaaggggaaacaggtacatcttcacatggccagagcaggaaggagagagagtggggaatggcgctacacacttttaagcaaccagatctcatgataagtcactcactattgtgagatcagcaccaaaggggaaatctgcccccatcatccaatcacttcctaccacagcccacctctaacattggggatgaaaattcgacatgagatttgggaagggacacagacccaaaccatatcaataacataattaccagattcacattcccatcacctttgacatattttgttagttagaagcaagtcacaggttctgcccacactcaaagaaaagggatgatacaaagacgtgaataccagaaggcaggggtcattgagggttacattagggtctgtctaccacaggaattgataatggcattaaaggagcaaaggatttagtgctatatggagtttgtcaatcatattgccagcaggaaacagatgggaccctaaaaccctggaatttagagtttaataaacgatttacaaggttgtgagcggagttgaaggaaattgtaaaagacagtacagtataccagggctcccaatactggggagcagctgctgtccttattaaggaataaccagacgggggagagcatggttactggattccacagaggatacttgcggggcacccgttaggagatgtgctcaaagaacatagctaactgtggtgacccgacaaaaatggaagtgagagaataaatactccttctagcttcttgccaatgcttctcattgaccgtacccaaccagaaggcagaaaattcagatcagccttcagtggcaacagagcagggtggaaaagggtgagtcatggatttatggaggtatttgaaagacattcagcacactgagcagtcactgaaatctctgatagaatgatgaatgaaatcagaatggaggagagtgagctggggaaagatagaataggagtcaggagaagaataaaggaacaggttcagaagaagtgaaaacagagcaagaaaagtttctagtaagaggtgatttcaggtgtagagattttaaaattagattgctcttcaataatgacaagagtcctgtgcttgtccaggaattagaaaggagtgaaatcaatttaaatataagcctagagacccctttatttgagaaggcaggtgaaatgtgcttattttatttttttttaattgtcagggaaagactctttccaaggaaatttcttatgttaggcttaaggtccctgaatttcaagcactgtaatttgaagcactggatttttctgagatgagatgtgaacgtatcattcatgctctatcagtgcttctcatccattatgatgatgaaaatcattcccaaaattagttttcttagtcacagaaagctgaatgccttcacatttggggaggaggcttactcatttaatgggtgctactggaatatatatcatcaacgagttgacctccgaatatgtgtacacggatgtgcgccactgggagtaatgatggcagatatttaattactgttggccattttcctgctccctgagctgtttggttccctccaataacaccctcaaatttgtccccctccctgtaattgaataatccctcatgctaatatcagcctgaaagaggtaccactgagaaggaaatacaaaactgtaaagagcctgcaatgtacttccaagcaaataaaaatgacttggggatctgtctctagtggcgttatctaccccacatctcttccaccactgaagagtgacaaggtgtttctttctgccttagtcttctttgcaatcttcccttctgtctcatttctgagcagagtcacgtcatgctgtaatacactataccatttaaacaaatgggaagaaatacagtagacttactgtcccgatttgtttttgttgttgttgttagtaatgtaaaaaccagtgactagtattttcatgattacttatggcctcagctttaaagtataccactacagcattttttctgtctcaaattctaatatttcagccctattccaattttatatccaggagtattatttggaattaagcagaaaaatggaggtgttaagaatttgaacaccaaaatagtgatttccaactactggtttatatgagtttttaaatagccaaggagattttcaacactttatctttcaacttttatgctttcaaagttgatttccagcctctctccaacccttgactatcactttctctgaattattaatgccacacatacacttaaatgaatatagttgtattttctacacagtgcagagaggctcccaggctcatttgtgttcagctgcaaaagaaaaaaaaaaaatctgaaaagccacttttcttcctgggtttcccacacagaagtcactgctctgtgaagattaccatttgtaagctaattctgaagttgttaatggcaagaatcagagcaattggcatctgttgtaaaacacacatttcagacaatctctcccactcgtttgtgagagctgtgtgacatagcagtgtgttctctctcgggggttcctgcaaagtcttgcttcatttgctttaactggcttttggagaatttttagagagagtagattaactcccaaacacaaagcagatctgtgacacttgatttgttgtaaaaccataacctgttttccattgatttccagcctagccacaaacatttttccgacttgccctcattacctcattcctgagctcagaaaaacaaacacacacacaaaaacactcgaatggtaaagaagctgtgttttctctctcttcaagagattctgattccaagtgcctttgggacgaatgacaagaaaaggagtttgtttttaaaataataggattattgaagagtcacagaggttctcaaataattttctacaaactgcaataatctgttaacaagcaaagatttcccatagcctacaaaatatcctgaaacattcccactcttaacagtatctcaaggcaaaaaccaataatggcagtgaaaagctaagagttaaaatattgtagaataccagaggttttaatgtctcttttaattagaaccttacctttctgttacctaaattccttaggatttgctctgattgttgtttcaagccctggcgaatctttgctagtttgttcagctcttctgcaggggaaaaggatctcactaacattggtaaagttaggaatagcacatatacaaaaacaggttgtttatttcctcagtcttctcccctctttaatcagattgcagagatcttaactaggcgtgcttccatgatgacatacatatccagatcttacatatcaagatttcaaagagcagaatgggcaaagatttaaagctgaaaatgtcacacagaaagtatatggcaagttccaaaaagctttgtcattgttgagccctagatttgacaatcattaatttcctattagtaagtcttactgtcaagaggactcattttactagccgcaggaagagtttgttctttggacaatcattgctttaagcggtatgtcaaaatcattgctttaagcggtatgtcaaaatcattgctttaagcggtatgtcaaatccatgcagacattcaaggtaagaaagagatgtaattaaatcttttcagtaaactggctaagcactcatctgctgccactgatagatacaatttgggggtttctaggatttctttaccctctcccttaatacatttaaaaaaaataatctttaatgccctaaacgcctgtcatcctatagcagaattggtattacttgggaatgttaagccatttctcagatgaataaagaaaattcacctcaaaaagctaactggattgtttttcccaacatgaacagtgtatgacatatattacatgtatgtattacttataattacatggtatatgtaagtacatgtatgtattacgtaattatgtaattgtatgtaatatatgtgaggtacaacatgtatatatgtgatatatgaaggtgaaggtcgccttgctccctgtcctgcttcatctgtgccctgttgtgaaacataatagcaaatatatcagcccttagcctttgggcagttctaaataccagattcatggagaaatccaatgggaaaatagtgctctcttcataaaagctttttcagaccatgtgctcctgaaatcagcaattttaccttgagaaaaatggccttttcagttatgtgcaataactgttctaccatgaatggaaaagtgtcttaaaatgccagcaatgtccccaaatgaagaattctccacttgctcaatttcactgattattctgttgagttacttagcctctatgcttctaaaacatattctgagattgctactgaaatgcagcatttgtcgttgagggctatcaatggtacagcaaagacttactccaatgcacggtaccaggaaaacactcgtgactgcaactagaatatattgagtggttatagtggtgtgtactttggggtccaaataagttaaaacatggatcaagctgcccaggtgtctttcaaactgattgggaaggtaaaatatagagaaatggaaaatcagcaaagatttacaaagtaacaaatggaataacatatgggacaactattgtatcagtcagctactgctgctgacaatcagaaattctcagtggcatacaataagaagaatttcttatgcgtgattcagctggagtttagctgacataggctgagctcagctgggcctggctccaagccacggggttgattcaggcctgttccacttgtcttttatgcttaagccaggggactgcctacatgtttttctcatggtgtcagtggtcaaaagctcccagagaagagaacaaaacaagtaacgctgcttaaggcataatcttgacttagcacacagtcaaatgcaccgacatgacattggctacagtaaatgacatggcgaagtccaacatcaatgaggcatgcaaatataataatatatatggaaatataaaatataaatattaaatataaaataagggaggggaggagggagtgaatatttactgaaaaataaactaccacaattattaatttttcagggcaaaggtaacatggaatactagaggaagcagcatagttggtagttaggagttttgagaaaccttggaactgcagttccttggcagttacaggtatcatctatgactccgggcctatctataaaccatctgtaaaatttttcatgactttttgagtcagcgagaaggtaagttacagtttttctcatcttcaatgaaaatgggtaaaatacagtaagttccctaaactagaacttattagaaaagaaaacctattttgtcatcatcaaattagtgtttaggtattcttttccagtggtatttttggggagaagtttgccgatattttaatctgttcatgaatgcttccttacgagaacttgctaaatgttgcaaccagcctccaggttgcgctgtctccgggttaagatttgtgttctgcttaccaccacactggctgtttaagtaagcacttcctgaaatttctaatcacttgatatagtatgaataacacccatggatgcttatataggggaatatttctctgatattgccacacattcggcctgtcttcatttaaccctgtcagtggggtatgctttataagtctgcaggatatagtttagaatgggcatgtgtgtaaggaagataaagaaatatgtggagagaaactctcacccttctctttaaacagctgaagtgggattaattcatctggatgacaaaaattcattaacaggaggaggtctaaatatgaaattgggacaccgatcggtgaaattttattgtaacaaactatttctaactgtgtgaccttggggaagacacatttttctgggctacagtttcttcatctgtgaaaaaaaaaactttgaactacatgggactttagaattttagtgctaacatcctggttcctttaagcagtgacattttattttccagtatcaagttaacatacaatataggtagcacagaatccaagatgacaaagggagagaaaaatatgaaccaggtttctgccatcgaggacaaacgtactatacacagaataagagagttcaagaagcagagtcagacatacaggaccagagtttcaagatgagcccagggttgctcctagaagggcgctagcctcagtaccattaggcaacaacaggttgaataatagggcttcgcaaataaagttatttacctcacacatttttgttcgtagctttagataatgcatgaagtccctggctgcatatatcataggcagtgtttttttaaatctgttagaaaagctttctttttcctcattgtaagattgggtggattcaatctttgagtctccccagagttaggatttcttaaagaaagtagacattagtgtctctgaatccttgaaatgctatggaaaatgtttcccatcaggaactccttactttgattttcaatataaaccacctgcatttgggtttctttaacaattgtaataattccacttttataaagaaaattataagaatattctgaaatttgtatgccgctgtcttcctgcaggaaaatgcaggtgatgtgaaatatagtatggtatggatttttcttttcttttttaaatgtccagactttatttattggcattaatctctaaacaatacagtataaaaactatttatataacatttgcattctgttaggtatcataaataatctagagattatttaaattaaatgagaacatgagtgtagtttacatgcaaatattagaccatttcatataaggaacttgaacgtcttctgatttggggctgcatggaaggttctggaaccattcccctatggatatgaagggtgagtgtgtacaatacttatttatacttttgttgtatatagctcccctgaatgtaaatttcacagaggcaggagtttttgtctgttttgttcaagggtgtcccttctccactttatttttttgtttgctttgtaaaagatcagttggctgtaagtatttgagtttatttctgggttctttattctgtgccattggtctatgtgcctatttttatagtagtaccatgcttttttgtatttccagcacagtagtacctgtacatattaagtgctgttagatatttactgaacatgaatcaatatatatttagaaatgaatgagttttctaagtatttatgattgtttaacttttatttttagtttcaggggtatatgtgcaggtttgttatataggtaaacttgtgtcgtggagctttggtgtacagattatttcatcactcaagtactatactttgtacccattcccattagttattttttctgatcatctccctcctcccaccttctaccctcaagtagactccagtgtctgtttttccccttttttgtatccatgtattgtcatcatttagctcccacttatacgtaagaacatgtggtatttggttttctgttcctacattagtttgcttaggataatggcctccagctccatccatgttcctgcaaaagacatgagctcattcattttcatgactgcatagtattccacagtgtatatgtacattttctttattcagtctaccattgatgggcatttaggttgcttccatgtctttgctataatgaatagggctgcagtgaacatacatgtgcatgtctttatggtagaacaatttatattgctttgggtatatacccagtaatgggattgctgggttgaatggtagttctgttttcagctctttgaggaactcctgtactgctttccacaatggttgaactaatttacactttcaccaatggtgtataagcattctcctgtttccacaaccttgccaacatctgttattttttgattttttgataattgccatcttgactagcgtgagattgtatctcattgtggttttgatttgcatttctctaatgatcagtgatgttgtgcttttttttaaatttaacttctgggatacatgtgcagaatgtgcaggtttgttacataggtatacacatgccatggtggtttgctgcacccatcaacctgtcatctgcattaggtatttctcctaatgctatccctcccctagccccccaccccctgacaggccccagtgtgtgatgttcccctccctatgtccatgtgttctcattgttcaactcccatctatgagtgagaacatgcggtgtttggttttctgttcttgtgttagttcactgagaatgatggtttccagcttcatccgtgtccctgcaaaggacatgaactcatccttttctatggctgcatagtgttccatggtgtatatgtgccacattttctttatccactctattattgatgggcattcggcttggttccaagtctttgctattgtgaatagtgctgtaataaacatgcgtgtgcatgtgtctttatagtagcatgatttataatcctttgggtatatacccagtaatgggattgctgggtcaaatggtatttctggttctagatccttgaggaatcgccacactgtcttccacaatggttgaactaatttacaataccaccaacagtgtaaaagtgttcctatttctccacatcctctccagcatctgttgtttcctgactttttaatgatcaccattccaactggcatgagatggtatctcattgtggttttaatttgcatttctctaatgatcagtgatgatgagctttttttcatatgtttattggccacaaaaatgtcttcttttgagaagtgtctgttcacatcctttgccaactttttgatggggttgttttttttttcttgtaaatttgtttaagttccttgtagattctggatattagccctttgctacaaagagaataaaatacctaggaatacaacgtaaaagggatgtgaaggacctcttcaaggagagctacaaaccactgctcaacgaaataagagaggacaaaaacaatggaaaaatattccatgctcatggataggaacaatcaatatcgtgaaaatggccatactgcccgaattaatttatagattcaatgctatcaccatcaagctaccattgactttctttacagaattagaaaaaactactttaaatttcatgtggaaccaaaaaagagcctgtgtagccaagacaatcctaagcaaaaagaacaaagctggaggcatcacactacctgacttcaaactatgctacaagggtgttgcgctttttttcatgtgtttgttggccacatgtatgtcttcttttgaagagtatctgttcatgtcctttgcccactttttaatggggttgtttgttttggcttgtaaatttaagttccttatagatgctggatattagaccttggccagaggcatagtttgcaaaaattttctcccattctgtatatgttgtctatttactctgttgatagtttcttttgctgtgcagaagttagtttaattgaatcccatttgccaagttttgcttttgttgcgattgcttttgtcatctttgtcatgaaatctttgccagttcctatatccagaatgatatttcctaggttatcgtccagggtttttatagttttgagttttacatttaagtcttaaatccatcttgagttgatttttgtatatggtgtaaggaagggttccagtttcagtcttctgcgtatcgctagccagttatgccagcaccatttgtttaatagtgattctttccccattgcttgtttttgtcagttttgtggaagaccaggtagctgtaagtgtgcagccttatttctgggctctctctattctgtcccctttgtctgtgtgtctgtttcagtgccagtaccctgctgtttcggttactgtagccctgtaatatagtttgaagtagagtcatattatgccccctccttttttgtttttgcttaagattgcctttgctatttgggctcttttttgggtccatgtgaattttaaaatagtttttctagttctgtgaagaatgtcattggtagtttgataggaacagcgttgaacctgtaaattgctttggcaatgtggctgttttaatgatagtgattcttcctatccatgagcacggaatgtttttccatttgtatgtgtcatctctgatttctttgagcagtgttttgtaattctcattgtggagatattttacctctctggttagctgaattgttaagtattttattctttttgtggcaattgtgaatgggattgtgttcctgatttgtctctcgggttggctgttgttggtgtataggaatgttagtgatttttgcacatcaattttgtatcctgaaacttcgctgaagttgtttatcagttcaaggagcttttgggccaagactgtgaaaactttttagatacagaatcatgttgtctgcacacagggatggtttgacttcctctcttcctgtttcaatgatctttatttctttcgcttgcctgattgctctggccaggacttgcaatactatgttgaacaggaatggtgagaaagggcatccttgtcttttgctagttttcaaggggaatacttccagcttttgcctggttagtatgatgttggctgtgggtttctcctagatggctcttattattttgaggtatattccttcaataactagtttattaaaagtttttaacatgaaaggatgttgaattttactgaaagccttttctgcatctattgaggtaatcatgtggtttttatctttagtttggtttatgtgatgaatcacatttattgatttgtgtgtgttgaaccagccttgcatcccaggataaagcctacatcattgtggtggattagctttttgatgtgctgctggattcggtttacaagtattttgttgaggatttttgcctctgtgttcatcaaggatgttggcctgaagttttctcttttttattgtctctctgacaggttttggtatcaggatgatgctggaatcatagaatgatttggggaggagtccctccttatcaatttttttgcaatagtttcagtaggaatggtactatctcttcgtatatctggtagaatttggctgtgaatccttccggtcctgggcatttttcggttggtaggctgttcattactgaatcaattttggaacttgctattggtctgttcagggcttcagtttcttcttggttcagtcttggaagggtgtatgtgtccaggaatttatccatttattctagattttgtggtttgtgtgcatggaggcgttgagagtagtctctgatggttgtttgtattactatgtggtcagtggtaacattctctttgtcgtttctaattgtgtttatttgggtcttctctcttttatccctttaatagtctagctagcagtctagtctatcaattatattaatatttaaaaaaaaacagctcttggattccttgatcttttggatggctttttgtgtctcggtctccttcagttctgctctgattttggttatttcttgtcttctgctagatttggggttggtttgctcttgcttctccagttcttttagttgtgatgttaggttgttaatttgagatctttctaacttgccgatggggacatttattgaaaaatatggaatgcttcatgaatttgtgtgtcatccttgcacagggatcatgctagtcttctctgtatcattccaattttagtatatatgctgctgaagtgagcatggtatggatttttcaaagtgtataatgagtcactattaatttttatattgaagacaatatcattatcatgctcaagatcatttgtagggcttttatccagagatgtgatgaaacaatgctccaaactctaggactccttatgcagtgataggagaaaaacaatgaccaaacacttatgaaacataggtagttagatttctttgaataaaattaccattttttaaatgtgaaacatgtctttaagactcctgcatgttaaggtcagcagtgattaatttagaaactgtgaatgttaattgaaggcacagtttcttctggaaccttttaaacgtttgactcatgctggttaattagaagggcaaaaatcactccattgtgtaaatatagggagagcttcttttccccactaatgtgaatacatatttgttgggttgtatgaaaggagaggaagtaattagccaggtgaaatgggtaaggtgacaatgactttgagatttcaaattatttccaatcttaggttttactgagctgtgccagtatacctggtcctaatccaatagagagttaaaaaccaatgttctaatgctttaataaggttggaattatacaccatggttttgtatccgtagataggtagccaaagcattctaagatttcctcctgccataatttttaatctaactagtaaattatataatctacaaaagactgcaatggccaagtcttggaagtatcagttactcagatgaagccatttctttgtatttattgttggtttgaccaaacctaaaattgaagaatttttcggaattgtccttgcttctctttcagatagcctttataaaatggaagacatttatagagcatctaagatttgggataaagttttcacaccttctccaaatctttctcatgaggtaggtgcaacctaaataatcaaagggaaataatatcaggttgagaaatgtataacattaaattattacagtgtttgtgtataaagtgagatacactcacataagagttgttacgcttacatggcagacccctggggcccttcctaggaaaattcacggcaaatcacggtagttcagtatccctcctcatcactaccatcctaaagaggtaaaatctattaaaatcagcactgagggcaatagtggcagagagaaggctgaaagagatcatggctgtaatgctatggtagtggagatcagggtgtggttatgaattgatgaattgtgtcttcttgcatcagtgctttcttcgttcctcttttctcttctgtacactcccatcctgagtcactggaagtctttgaatgcctggtttccggaggagaaaatcatctcatagtgtctcgatttgtcataactagacataatgactaagaaccaatttcagttttctagcttttgttttttgtttgttttaattcacagttatgtagatatagccattgagtagaagttatagagtcaacccacttctattttggatgtgtttcctcctgataagttgagcatgaaatctaaatctcatgaattttgagtaagttattttgaagtctatatactgtttagagttttgaccaaaatagtttgttacagtatgctttgttttacttatttaagagactatatggccaaaatataaatatacctaaaactataatttctaagtgcacccattaggaaaaaaagcatttatcaaatattttcacatatattttaaaatctcacttgatactagaataaaattccatgtattttattccctcaatatgtcattaaagcagaacatgctgtgaggaggaaataaaaagagttaagcacgttttcattgtggagttccactctctatgtatagaactctatatgacggtcatggaaattaaaatgaatttgatgttagcagtaattaatttgcttattctaataatataatgaattaacagatttttgttcttatatcaagtgggaaatgattttatcgttatgtaaatataacaaaatgtaaaaattttaaggaaggactgcatttaataatgatttagataaaacaaggggggtttttatttggttttgggggtaaagatttttttgttttggggtgttttttggtttttttttagcattttaggtttgggggtacatgtgaaggtttgttacataggaaaactcatgtcatgggggtttgttatacaaattattttatcacccaggggttaagcccagtacccgatagttacctcttctgctcctctccctcctccctccctccactctcaagtagacccccagtgtctgttgtttccttctttgtgttcataagctctcatcatttagcttccacttataagtgagaacacgtagtatttggttttcttttcctgtattagtttgctgaggataatagcattcagctccatccatgttcctgcaaaagacatgatctcgttcttttctatggctgcactgtttgctttttaatgtggaaggaaactatttttttgcctgtcgagttctgttacataggttcacaggctaaacacatcaccatcacagtgagttgtgtacaagctgtgagtaaaggaaggcaccaaatctctgttcaatgttcctattcctcccatgagttagagatggaggcataagagtagtccttgagtaacggagaggttatgctcctccgttactccatctaggagaccttatgctctgagaaccataccacattcatgtctagccatctatatatctagatttttaatgaatcatctatgtgagcaataagatagagggctgtagtaaaggattctttcagtcaatgtgaataattacactgaaagtatttgctttgtcaaacatattattaatatatcataaaaagttttgggctaggcacggtgtctcatgcctgcaatcctagcactatgggaggccgaggcgggtggatcacctgaggtcaggtgttcgagaccagcctggccaacatggtgaaaccctgtctctactaaaaacaaaaattagccatgcgtggtggtgggtgcttgtaatcccagctactcgggaggctgaggcaggataatctcttgaacccaggaggtggaggttgcagtgcaccgagatcgcaccattgcactccagcctgggtgacaagagtgaaacttcatctccaaaaaaaaaagtttttgataacatatgtgaatttataagacctgtccgggaaaatgtatggtcataaaaggaaaaagcatgtgcaattattgcttagtgtttttagtgtttcatgagtaatggaaaaataactgtacaaatattaatgtgatcaaatgaaacacatttaagcagatttaaaaaccatagcaagtcatctttttcattaaataacagaaaaattatgtcctgacagggatctccaaacatttttctacccaagtattgtttaactttatgtcatgtatgctcagtagaattcttcaattacactctaaattttctaagtgggtttcccttggaattttatggaaaaggggaaatatctttggactattttattatttccaatagaaaaatgcatattttagcactaatactttttccccaggaaaacttcaggtcctgcgtaataaaatattggggaaaaattgatgtgagtttatataaaatactaggaaatcaagatggtggggcataatttaggggttttgaaatccacatggaggagtcagtgtagagtctcaagttgtgtcacaaaatgacgttgtaatccacaaagctagttgaaaatgattatttagctcataggcacacacaaaacttctcatttgcccttctgaatgactgtgagaacaagcccatgctgccctcgggacaggaaaatggtcctgattctcatggcaaaaaggtattgtgaacctctttggcacagctttaaagagcactcccattaccttcttagtcttccaggcaggatcttcttttctcccaccacctccttaattaaagcaactctaagttttcaaactgtgcctcccaccaagctttggtttaaaggattctgacgacaaatatgtaaaactattaaaccaactaatcaccagcagctcattcccttgccttcgtttctcccagaaatctttcctccataaggaagtattaacatatatatttttgacgaagcattgtataaagacatccttttatttcttatttaattttaatgttgaagtctacacatcttcagaagtgaattgtaatataagtaaaaaatctaaaagattggagatatttttactaattcaagtgtgttagcccacacagattatccctttctaaatgagtatgtatgggtggggaggtaactcatcttttcatctttcatatgtattcatttaagtatttcaggttcaagcatagcatagctatgaaaaaccaagtcctaataatattgtacatggaaattaagctttaatataccatatactttataacttttactaagacttttactttcaaaatgtttggcctatactgtaaagataaagacaaagtggagaaagtggcagaaaattcaaatggtgagaaagcatgaaacttgttaagtgtttatgagtgtgcttgggtgtctaaggcagaggatttgcatgaggaaacaataagatataatattagaaagagggcttagagccaaattgtgaaatcattgactgaaaattagaaagacctgaaagggtcatttacttacaccttttctctgatgcacaaacctcctctccagcatcagtaagaagcagtcatccagtctgttacatatttcccatgtcatccaacacatgacttcaaaggcaatctatttcattgtttgacagctctaataactaaaacttccttctgttagaactgtaactcccaccattgctttttgttttggctctggaatgccaaatttttttatcaattattttgaatgttaaaaatcattaaaaataacactgtgatacacttctgtgtgatttatgtcaaattccataagctataacaatttgaattcattttgcttattatccagaagagatgaatgtatttcttattatgtgtcaagcactgtaagtaattttcatatgcaaatgtattcatcctcataacctatgaggtaggtacaattattatcaccaatttttccaaataaggaaactgagatacagagaggttaagtaacttacccaaggctatatagccagtgagtggcagaaacaaacagggctacaagttagcataccctagtaggaatgacttacttaccaactcatttccagtgtctttgcatttaaagagggaactagaagagataaagtaaaatactaaaaacggaaacatacttcactggattgccataagttgagcttaatgctttttttctcatttccaggtaactcatcagtcaatccaattcttccatcttatatatgactctccatatccttgttctctttcaactcatctttccatttaatttcttattttcactttcaaataaagagttgggagggctactttactaggtcttaagcatcttgtatactggtgtattcattttcttttcttttgaaatcaacaactaaatatttatattatgtgtaactcacagatcttggtagtgtaattttaggaaatggtaacattttggagtacagaatgtgttctttctccagatacatctgagttgctttaacagtttcatttgactttttatacctgtctttatagtttcagcagttgttcaaaagattccatcaccatagatcaccatttactaatgttaccaatatacaatggacacagccttgaaatttgaatcttctagatcccagtaggtctatacagagagataggttaaaaaaagatggaaaatctgcttcatagaagtaacttgtctaattttaagtaaaactctaccatttcaaactcaaaatacaggtacaatagatgtactaaccatgttagggtgtgtgtatatgcaggagtatctgtcagaactctgctcatatcgttttggcattcatagttccaacaaccacaactccctgtctcagggaatttttgcccaatgcagtatgcatgaccaaagcccagggctggttggaagtgtcaggaagttaccattggttaacccagtaatcaatgacgaagtagaactggtagatgaatactcaacgctccttgcccttcaggtagaacaatgatgaggcatgttctacccagtttcccagaggttctcaataggattcagtcctagtttcccacagtggtaaccaatcattaacacacttcatattgaccacttttgcttttctttcttgtttctccactccctgctggtaattacctcctaaatgtgggctgaaaccttagtctgaagttttggttctggggaacctcggtggatattctctttacagaaggaaactctgtataggcatagtcgtctagagatagacactgcccttggagaccatgttgtctcaatttttcatgctggtacttggcaactgtgtttgcagctatgtgtactatctttatagatccttcctttttcctgctgtcaccgtcattagcacccagatttttgttttctttacttctgttttctcctattgttacattctaaacacagaaacactctgcttagtggggtgaggttctgggcatgcaatagtaagataggcattaatctttcttctcctctgtaatttactattataatcaactcagtccccaaattcattcttccctcaccctcatatctgttaatattgctacgttctatccattaggccacacaaacatctcctaaactcagccacctaccctcatagacacactcccagctgcagaccttattattccttgaaaacctcagtttcgacaccagtccttcaaatctctaactaccctcactctctttacatttcagtccgtcatctaccctacttccagagtgtttttcacgattataaattttactgtgttatactcttgtcttaaaacccttcagaggtgccatattaccttgataactgttcagttccttcgcatggaacacaatatccttcattatctggctcctaatcacctctgcagacatgtcattgttcacacacccaactaagcactactatccagccccggtgagtcattttcagtttcctgaacacatcatgacttttcaaagggccttccaggtatgcctgagtctgaagcctgttctctttcacccatactatggcacctcccatgtgctatttcacaaatgctgctttaagcaaaaatttcctgggagcgagaatgagaaggaagggaatattatttcaagacttttacaaaataactgtagacatttcacttgggaatttctaagtgcaatagaaatctgagtgagtaggtaaaatagctacataaataaaatgcacaccttttaggtcacatggggagattgccttgaggtttaaatggctgagatcatttccacattcctcacagctagccatctataatcaaacagcaataccagtcggcacacattcatcatctccaaagaaaaggaaagtcacctccataaatctcaaaatatgggatattaaaagttggtttttataatagctggtgcaaaacaatttgtgcaaacaccaatcaaaagtaacttctactttagttgaatccatgtcccaagattcagaatttactcctgtaataaaatctactactactcttttccttactaaaagcaaacataaatagactgtaataatttaaatcatttttaaacaaaaaagtttgggtttgattggcattagtaaattcactatttaatatattgggtaccaatcagcttcttacaaacacttctagaatgttatgccctagttcacaccttcacctcaggcaattctccctttcattaccttgattgactgtggaagaacaatgcttctaaatataactccccttctgaaatgctcttggaatttcttctatctacctcctattttctttaccaaaaaacactatttctccctcaaataacaacaggtcccaagatgtcaaatttctagaaagaaacagaagacaacacactctgtattgcttgttccttagtcatttttcagggactaattatatataattaattgtctaggcctatggttggtaaattttttttctgtaaatggtcagatagtaaatattttaagcttttcaggctgtacatttctgttaaaaccacccaactctgccactgtagtacaaacacagacctagacaatgcataaatgagcatggctgtgttccaataaaactttatttacaaaagtaggcagcaagtagatttggcccatggaacatagcttgctgacacctgatccaggccacttaaatcctctctaacatcccagacgccaacaacgaaaggtcattcaaattattttaatacaattttgttgagcaaagcttataacaatcgccatctttctttgaagacttctgatctcaaggtagatataatgatgataggtacatccacagcacatgaaatgattagaaacaagacaatagagacattgaagtatacactatcaattgcatgtcaaagggaacatatgattagagacagagcagagactgggaaaattcattctggctattccctgtcaagactgaatggggatatgttaatccaatcaatttggaagagtggaaaaggatgagattaggttacaaggctggcttcttccagttaccaatgaccgtcagaatttgaaaaagtcgtagcatctctcagacctccattttttcttctgtaaaatagagataatacctgccttgatgtctttatccaggctgctggaagattatatatatgaaaacactctttaaatagtaattgtcaactacaaatgctagctttataaactcattggagtgtgaaggaatctataagtttgatgattcttttgaagacttttacttgattccaatacactgtggaagccccctgatcattttagttgctactcttttgaacttttctgtcttttttacatcttcctccaggaacaatgagcagaactaaactacataatacaaatggacttcctatgccaaatagcaaaaccttttaggggttatggttgttgttgttttttttttttttttaatggtggtgtcctaactcaatttgtagtcattcctgctaagtaagaaaagagggatggagtcaccttaaagctaatacccagacacctccttctacataaaggagagcaaaagaaaggcaaggctatgaaattgaacctatgctcttcctcagctctcattttaaaccttattggccagaccttattaattaaaactaatttatttatctatagaaagatcagctactggcatgtaatagttcctcaaaccgactagaagatacgtgagtcaaccaaaatacacaaatcaatcattagtggggatgttagggcttcaaccaagctcagtcagttgaaagtgtggttaattcaaccattcctggatgcctcacaacatctaccttggtaaaaccttaaaaacatttcaacaaatttctctgctatttcttttttaatcctgagtgcctcttgttcaatgattatctctgcatatcattgaaaacattgcattattggttttaagaggctcttgaaattatgtttttgggcttgtctaatttctaatttgctcacacctgcaaccatttctgaacttccatattcctcacttgaggaaatctttaaaaaataaaaaagttaatcttcttcagctcaaaacaaggttcgatgtttcactcttgtttctgttatataggcaatctctttagtacaaggcactgaactcaaatataaaccagaggggaggtcttagagaaaacttcactagggccctagagccctctatatctagaaaaggtaggtttagttaatagaaatggaagattaccaaagtccctttaacaagagactattgatttttggcttataaattatatttccctcctgttttatcatgcacatgagtattgcaagaaaagcctaggcagtctcttttagaatatgctaaataaatctaagatagatatattttaggtatgccagccttcataccttatagtaaaagtcaagtccatcttaaattttcctccaggggcttaattattgaagtaccaaaatgacatggctacaaaacaataccatgtgtaaaactgtagcttgaaatctgaggaaaaaggcaacctgaatttcaatatctcacattcagtaggtttgcattttctctctttgacatttcactgcatagccatgttttgtctcactgaattagagattttccttactgctcttactcaaatattcttgctaaccatcttttgtttctcttggggccttgaaagaccagcagtctgaaagtgcatcttcttcacatctgttcatcgttctgtgacagctgcagcataacctgggcggcatactcgtatacatcatatccatgttgattgcaatgtgtttcagtagcttaaaagcacattaaaattaaaatgatctttgtcaacccccagaaattgtgctgctcaccaaggaacactttgccagtgacgaaaggttcatattttgctcttcccctcgtgatacactggggagtttttttcttgtaagctgagtgaacgagctgccagacatatctcctggaaatgcctggaagagaaatgagctaagaggaaaacagcagactttgaaagagagatttgccagcctgcatcaaatcaaccaccccaacctgggctcctcacagggactcagtaagttcagtctactggcaaatcatacaccataattaactatccttaattcaaatgaacatttttatgggtccacagggtctagagagaaaatcgttagcttcactcactaattttcagttaatcagcaacagttcactcagcagaacactattagggcagccttgattagaagtatagggatatgatattaattggcttcttctaacagggatcaggatgctaaatggcaaagaccatctgtagctctggaaaggaaacacttgaaaagcactttttgaaggtaaatgataagacaggaatgctttttaatttgtaactccgtctacaaaatattttatgtttcttttgtcattattgttttgattcttctctttagaggcaaaaacttcttttgaaacctatggttttaagggacatgcaaatgctgaagcccgttgctgtttgactaaatattttagattttgacttgagggcacagtttaagattattgaatatatgtataaagcttatgcatatatacacatatttacatatatgtgtgtgtgtttgtgtatcctagcagaacaccagatacacagaatttcttgaacaaaatcacttgataaaaagatgaagcaaaggcattcttcatagctgctttttattagatatgtctttgaaaaattaaaaacacatgctaaatagcatttataccgagctttgaatgagagcacaaggagaaatttcctattcagtaaaaatccagtcagaattttatttattgcagtaaaatctcaattctccaaagtactttgagaatggaggatttagttaatttaattttcctactaattaaaatttaaatctagtctccccttactctaattctaattgttagatattttcttagtaagttgagcaaagggaatgtaattgaatcattgatcatttaggattttcactagggtcagtaggaagatcttttttcatactataatacaatagaggtaggtaaaaccggcagatttaaatgagtagtaactttcttttgaccctgggactattaggtgagcacattccctctgtctctctgtgtctgtcttgtgctatctctgtgcctctctccctctcttaactaaatctctgaaataaacttgctttattctccttcccctttagttttttctaatggattaaaaacggactattatttgaaaatgtctttatggtattttacaattaataaaaatagtaattttgtagttcctaaggaaaatatctctttgtctcaatatcttgcataaaaataagtcaaagagccaaggtttgaatctattattcatttgaggggagcagtactttaacatagagaaattagaagataactggaaattgaagaatctataagatcctttccaactgtaacaactagagtctaggaccaagtgttaacctctctctttttacctaacagaatgtgtgatttctaaggattattgagatcttcatttctgtatcttctgaaaggataaatgatcttgttcagatttggcaacatggcattaagctaatatccacccctcaactaaaaacacacagaaattctgaatagaatgtgaagcaaaataaatctacaatcatatcagaatatttaacataactattagaaatgaacagatgaaaaacaaaatgaataaacgtatagcatatttaaaaatttcaagctcaatctaatatatatgtatatatgtatatgtgtacatatatacatcgatgtagatatgtatgtgtgtagatatatacatcgatgtatatgtgtgtgtacatatatacatcgatgtatatgtgtgtgtacatatatacatcatgtatatatgtgtacttatgtatatatatatatgtgtgtagttatgtatatatgtgtgtgtgtatatatgtgtatatataaccctgcatccactataaagggctataaattgtttctaaaacacattaaacatctgaagacaaaataaatcttaagaaatcctcccccaaattatataagacaaacaaaattctctaactacaagtcacttaaatttaaactaacaagaaaatggtagtcacacaaaagacatacaaatttggaaactgaaataggcacttctaagtaatacgtgaattaagagtgagtccgaatttttaaaaaactgtaagtatacaaaaagacagtgaaaatcctccatagtaacacttgtgaaaggcaaacaaagcaatactcagaggtaaatttatagctttatgtgctataaatatgtgcttattttttttttattatactttaggttctgggatacatgtgcagaacgtgcaggtttgttacataggtatacatgtgccatggtggtttcctgcacctatcaagccatcatctaggttttaagccctgcgtgcattaggtatttgtcctaatgctctccctcctcttgtcccccaccccccgacaggccccggtgtatgatgttcccctccctgtgtccatgtgctctcgttgttcagctcccacttatgagtgagaacacgcggtgtttggttttctgttcctgtgttagtttgctgagaatgatggtttccagcttcatccacgtccctgcaaaggacaggaactcattcttttttatggctgattgtttaggtttttaaaaataagaattcagttggcatgatacggaaaaaaaaatagtgatgatgatgatgatgatattagttaatacaataaagctaatactgtgctattattaggtaccagaaaaaaaaaataagaattcaaacttaagagaaaaatatgtagcaaacttaaaggaagaaataggaaggaaatgatgacaacaaaagcaaaatatatatttaaaatacaatagggataaaaagagaaataatataacccagacttggtacttttaaaaactgaatgaaatggacaagcccatagcaggctcattcaataaaaaaaaaaagactgaaatttttaaaaagtaagaaagaatttgtacagattcttatagggggatgcaactatagttagagtggggattttaaaaataagagaatcataaacaattttatgccaatacatttttaaacttagaacaaaataattttcttaaaaagcatgttacaaaattggttaatgaagacaaaacctaatcaaatcaacaattttttaaaaattaaataagaaatcaaaactattcctcatccccatgcaaggtatcagttgcagtttcacaggaaaagatattcatcttatacaagcacttgcaaaaatataaaaggtaaatatattcaattatttttataaaatataataaaatatattaaaccagaaatatattaaaacagaaaatttcagtacaatttaaggatattataagcaaatataactgaacatagatgcaaaaatacagataatttattacaaaatataattcagctatgtattaaaatgtataatgaacaagtaaaggagtgtgtattccccaaattcaagaatagttcaggttttaaaatcttgaatataatgaaatataatcttttaataaaaaattaaagtagaaaagaatcatcccaataaaagtagggaaaaataattcaataatattcaaaatcctttgttgtaaactttaactcttatagtaaatattatagctaacattaaaattttagagttgtcataactatttttactatgatccttaacacttatcattgtaatgaagatcttagccaattcaattgctctagaagtaagagggataaactctgaaaataaaaaggcagaattgtttatcataaataatatgattggctacatgaaaatttaagacatttctaaaactcttaacaccaacagcaaggcttctgtatataagattagccacaaaaatctatggcatcgccatagttcattaaaatagaaaatatcaataaatatttcatccaagataacaattacatttttaaaaagacaagaaatagctccaccaaattttgtataataatgtttctagagtctttaaaatgtaattcaacaatataaaggatgatatgattgaatggaaacccataccatgttttatggtggtaaaattcaatattgaatagattttgtttttttgcctcagagtaatctataaattcagtgtaattttaacaaagtcctgagaatttggcaagttagctgaaattcatatggaaaaggaaaggacctagaaaaaacaatttggaaaaataaaagagtaagaataagatcagattcctttctcccttgccatgtgtcaaggctgattacataaacatctattaatcaaaactcgatgatagtgacaaagtgctagacaaacgttaatggaatagaataaaaggcctacacacacacacacacacacacacagagcgagcgagagaggttaatgttttacgtagatgactttcaaagaaatgcttatatagagtatgctttcatatcttcatgaaaataaaatcaagtcactatagctcccatcataaaatgttttccagttggattcaagtcctaaataagaaaggcaaaacattatgacatgataatgaagaactacttaagatacaaaatcctatattacatatcctataaattaaaaaagtggataaaatccatgttaaaattaaaatttgtaaaatgacaaaagaagtaataaaatttaaacccaggagatatttgcagtacatatgaccaataaataaatattttcaagaatatctttttaaaattcctaacatcattacagaataagttataaacctggtagaggattggagagaaaattcacaagtgagaaaatctgtatgaccgtttaatatgtgaaaagatacttagcctcactgaccatcatggaattgcaaataaaacagaaatgagatataactccctaattaccagatgagcagttataaaggataatcaaataataccgggcatctgaaatgtggagaatagaaactttcatatacttatgggggaaagcgtaagttggtataaacactttggaggataatatggcaatagctagtgaactacaggagattatcatatgtcttagcaattatacatctgtttatgtaccttgtgtatatttaatctactttggaaaaggcctatttcaacctactacaaagaattcccataaagtttcaaagaaaaaagaggaactcacagttaaaataaattacaaaatccatgaggaaacaaggcataatggatgagaaccaacaaaacacaagcaatagaaacagatctaaaaaactttcagatatcgaaattatcaatacagaatataaaagagcaatatttaatcttattaaagaaaaaagctcagaaatatgagcaatatacaaactaaaaaaaaaaaaaattaagcagtcaggcacagtggctcatgcctctaatcccagcactttgggaggccaagcctggaggatcacttgaacttggagtttgagaccagcctgggcaacatggtgagaccccacctctactaaaaatttttaaaataagcctggcgtggtggcatgcacctgtggtcccagatacttgggaggctgaggtgggaggattgcttgaatctgggaggtcgaggctgcagtgagctatgatcaagccactgcactccagcctggataacagagcaagaccttgttttttttgttgtttttttttgttgttgttgttaagcaaatttggccaagattcaaatagaacattttaagtaaaataattaaaaattgaagtgaattttgtatcaacaacagatatgaactaaatgaaaataaaagatattgaataaaaacatagacctaagtatagccattgtggaagacagcatggagttttgtcaaaaaaaactaaaaatagaactaccatatgatccagcaatctcactgctgggtatatatgaaaagaaaggaaatcagtatatcgaggagatatctgtactcccatgtttattgcaacactacacaatagctaagatgtgaaatcaacctaaatgcccccatctacagatgagtggataaagaaaatgtgtgtatacataatggaatattattcagccacaaaaatgaagtcctgacgtttgcagcaacatggatggaacaggaggacattaatttaagtgaaataaaccagtcacagaaagacaaatatcacatggatagcacatgttctcactcatatatgggtgctaaaacagtgaatctcatggaggtaaagaatagaatggtagttgccaaaggctgtgaagggaaagggggagaaaaggatgaagagaagttaaggggtgcaaaaatacagctagataaaagaactaatttgttgtatatttcaaaatagctagaaggtttatgttcccaacacaaaagacaaatatttgaggtggtgcatatcccagtcaccctgatgtgatcattagacagtgtatacagctatcaaaatatcacatgtacccccaaaatatatacaactattatatatcaataaaacataaatgatatatggatctaagcaaatggcacaaaatgtggcctaaaatgatcaaagttggaaaatgtgacaggttaaaatacatgaaagagtgaaagtttgaataagagatctaactggtaatccagaaggagatagtagaaagtagaaaaggcaatattcaaaaacacaatggctgaaaacgttcaaaatgtggttaacaagagaacaccagttctctaatctggaaagcccagtgaagctctacagaatatgtaaaattaaacatatatcgagacacatcatagtgaagctgtagaacaccgtaaaagggggaaaatcttaaaatcaaccagacaggaaagacagataacctacaaagccagagtaattagacagatagctaccacctgagtagcaacaatgtaagctagaagacactggaataatattgtcaatctgctaagtgaaaaaacaactataccaaacaaacatgtattttgggagaaacaaccaaatgaaaacattttcaaacaggactgagagagtttacttcaaaaagaccctatctaaaataaaattcaaaccatatattttagacaaatggaaatggtcccatattcaaggtccaagattggagatggtataactataacatccaatttgtgcttgtgtggggaaataggtaaaatcagaacacttgacagaaataacataccttaggaaagataatcacattagagttttctaaggtccttgtcttgtttcaaaaggataaattttgattgcttctatattttcttaagaaagaatgttaaggccgggcgcagtggcttacgcctgcaatcccaccactttgggaggccaaggtggacggatcacgaggttaggagttcgagaccagcccgaccaacatggtgaaaccccgtctctactaaaaatacaaaaaaaaattaaccgggcatggtggtgggtacctgtaatcccagctgctcaggaggctgaggcaggagaatcgcttggacccgggaggcggaggttgcagtgagccgacattgcaccactgcactccagcctgggtgacagagtgagactctgtctcaagaaaaagaaaagaaaaataatgttaaaataattgggataataagtaaaacaaacaaacaaaaaatttagcttattgtctccaaaaggtagggacaatggaatgagaaaaacggtacaagaaggtatgaaataaaaaagaaacaaaaaagtagaacaaagtaaataatttacttaatttacctatataaataaatataaatatgtcagtacttataaatattgttaaatgtttcaattaagaaacaaacactgccagttggatttaaaacacatacatttataaaactctgctctatactgttgacaatagacacatctaaaacataaggacatggtaagggaaagaggcaaatactaaggcaaatactaagtaaaagaaagctgatttcattgtattcacaaaaggtggggtgggagaacagtaagtcttttggtaatgacagaaagatcaattcgctagaaaatttaacaatttgaaacttgtacatacctaagaatgccatctccaaataaccgcagcaaaaatgaccaagcttcaagataaattgataaatctaccagtatagcagtttatctaaacacttctctatcagtaattgataaatgaatgggaagaaaaatagggccaacagaagctctcatttacttttagtggaaatttaagttgatgtaaatattctagaaaccaattttccgcattatgtgcacatatcccgtgactcagctattctatatttggttatatgtcctagaaaaaattttgtacatataaccaggtgatacatacaaatatgtttatagctacgttgtacacaatagcaaaaacctgtgggaaaacaaatgtgcacagaagtagaatgggtgaatatatgatgatgtattcatgcattgggataacacggggcaatgaattactgccacacatcagcatctctaaatctcagaaacataatgggagcaaaggaagcaagtcacagaagaataaaatattgtataatcccatttatataaggttcaataccagggaagcaaaataatgtatattttagctatgtgtatataaaaaaatagaaaatcctcataagcctcaagtttaggatacctgttacccctgttggaagtgacaggagagggaaatacaattggtgagaggcacactggaagcatttaagatactataaattattttaactttagtaataagtacaacgctatttattcttactctttaaattatatagatttttaatctaaaatatttaattgaaatacaacatatacagaaaagtattcaaaccataagtgtacaatatggtgatttgtcatatggtgaacaaatgtatgcatgcatatgtacaaacgtgtgaaaatacctacaagatacattttatgcattcttttaaggtataatatatctcaaaatgttttaaagggcagtggtgtgcaaagatatggacacacacataggtaattataataagcatttactgaaaaaaattaataatgattaatttgagacatggttaaaacaaaatggcaggctagctagcctgtaagtccaatagtacaaacaagcaaaactaggaaaaaaaacagtgtataaaaatgttttaagatctgtttaaaggtattagagaactgccaaggcagaaagaagtgaggaatcaataacccagagagaaaggaagcccacagagaagagaagtcttatcattggtgccgcttttcttcttgaggtgttttccaattctaaacttggacagactaagaagctatgcataactcctgttatctcatgaagacggggagggaaaaaacgagttcgaagcccgccaaggtaaagatgccctggtaaatacgcaagaatttagttgaggttctcaaagggtataccctaggattgagaataaaatgaaaattagaggagctctcgcagctgtacaaattcagccttgaatcagctcaactcctaattgcattaatgtgatctgttcctgcctaacttacatgccggggggagaaaaagcatatcctttttgagggacaataacatcatcccaaatgtcaaattatatctacaattatttgtatacaatacctcgtatttaatcaaagccaactagcctgcaaaagaccagaattcaccaaaattcaagggaaaacaagaacaataaaaacagactaatctgagacctagctaagttacttaacacaaactgtgtcattactttgataactatattcaaaagattaaatgaaaataaaatatgaacagacaactagtaggtcttaattaagattctaaaatttaaaaatacaataactgaaataaaaacttgctggttaggcttattaggagattagacacaactgaagagagaatttgttaactgtatgtaatacagggcaagagtaaatatccagactggatcacaaagagacaaaggatggaaaatacaaaaatagcataataatgtaatagtgaaaaggtggtgcatgaattcaactggaatcccaggagaggaaagagtcaaatatggaaagcgccatgcttaaagacacaaaggcacagaattttccaaaattgattaaagctatgaagtcacattcaaaacaagcattacaaactccaagcaagttatatgcaaagataaccatattattatttagaaataaaacaacatctgagcatatcataaaactgctaaaaatgaaactcaaaaagaaaatcttaaatctgaagtaaccctagaaggaaattagatgtgcttccttcaaagagcaaaataagactgatagttaactgtgtaacaaaatatttcctcaaagtgccaaagaaaaataattgccaacctagaaatcaatatctaatcaaggtattcttcacagtaaaactaaatgcagatatacactatagagactacaaaagagaaggtaaataaatcccacagagaaggatacagatgcaataaggaacgaaaaacagtggaaagagtaaatatatgggtaaacctaaataaatctgactgcataacacaacagttatgtcttagactgttttgaatataaacagatttaaaattcaaaaaagaacagcataaaagcaggagaggagtaaaaggagttaaagttttataaggtccttccattattcaggaaactataaaattactaatttattttagagtttgaaaagttacgaatgcaggttataattcctggagtaaattgtgaagtgatactaaaagacagcatactaataaattaacagaaggtaaaaaaatgaaatattaaaaaaaacccacaggaagcatgagagaagagcaaaggggacatacaacaatgacaggtagaataaaatagtagatttgatactaaatatatctgtaatcacattaagttatatgtaccgcatgagagaagagcaaaggggacatacaacaatgacagatagaataaaatagtagatttgatactaaatatatctgtaatcacattaagttatatgtaccaaatacttccattatgtacgaaaaacttcaactaaaagaaaacaatgactaagctacttacaagagagtttaaattcaaagatacagataggttgaacataaaagagtgagagggaacatttcaaacactaaccaaaagaaaggtgaaataattttactaaaataactagagaaaaggaagaacaattcatagtggtaaaacatttagtttaccatgaggattaaacaatttcatatttgtgagcatctaacatatttttttaaaagcactgagataaacactaggaacaataaacaaatctacaatcacggcagagaatttaaacacatctctgttagtaactgataaaccaaaagaaaatcgggtaacatggaaagttagaacacatgattcacaacttgacttaattgatacatagagaatttagcactcaacaattacagaatacacattcttttcatgtgcaacactaaccatatacttgggcagaaagtaagtctcaacaaatctcaagaggctgaaatggcacagagtatattttctgaacctaacataattaagctagaaatctgtaacagaaagtataaccaaaaaagggcccatgtgtttggaaattaagcaatataattttaaataacacgtggatcattgaaggaattacaatggatatttagaaaatggtttgaactgaaagataatgaaaatactacatataaaactaaagccatacatagagtaaaatgtatagcccataaagacgttattagaaaagaagcaaaactctgccgatcgacaatataagtattcttctccaggtattagtaaaagtaaacatcagattaaattcaaaggaagtaaataacaaaaagcagaaagtactgaaatgaaagtaattgttcagtaatgaagaaaaaatgcataaggtggctctttgaaaaaacaaatgacatagttaaacccctggcaaagtgaatgaagaaaaaagtgtgaaataataaatataacaaatatataaggggacatggctacagaaatttcagataacgagagggtattttgaacaactttttggcaatgagtagaaaatctatataaatacatgctaagaattgaattgcaatttaaaaccttcccaaagagaaaattccaggccaaagtgatctgttcaaagatttaaggaatcaatgtaaaaacatgtcttccagagaataaggacaaaaagatatttctcaactagttttatgagaccagcataaccttgttaccaaagtctgacgaagaactttcaagaaagaaaagttacgcaaattttctgtcgtaaatatatatataatatatgtaaatcttaagtaagatattgacatatcagattatgtgatatataaaatgaatatcataaccaagtagagtttcttgtatgagtgcaaggttggctaacgttagagaaatcagtcaattcattcactaatgtagcagaataaaggagaagaaaaagtcacgattatcacaatagatgcagaaaaaaattaaagacccaataaaagtcaagacaatcttgtatgagagaaacaaagctagaagcttgtcaccactagtaatcagacttactgtaagactacattaagacagtgtggtatctctgcaaggatagacaaatagaccaatagaaaataatagagttagaaatcgactgacaaatatatggacatttgatttacaataaaggttgtaatataacagtatgagaaaaagtctggtccttttaataaatggaaaaaaaatcatcttaatcaccttataccacacaccaatatcaattccaggaggattgtagatctaatgatgaaaagctaaataaatcatccagaaaaagaatagaatagcttcatgatattgtaatagacatgatactgtaatgatttcttaaacaagacacaaaaacaccagaaagaaaaaagtgatagtcatttttttagagatggggtctcgctatgttgtccaggctggactggaactcctgggtttaagtgattcccccacttcagcttcccgagtacctgggactacaggtgtgtgccaccacaccaggctatattttttaaggtagtaatttcatcacaagaaccattaagagagtaaaaaggcaagccaccgattgttagaagatatttggaatacatataagtgtcaaagggcttgttcataaaattcagaaagatctcctgcaaatcaatgagaacaagggagacaactcaggaaaaaaaacgcgaaagtcttgaacaggcacttaactaacaagaatagccaaatagcctataagcatatataaagatgcttaatttcattagacctcagggaaatgcaaagtaaaatcacaatgaattcagactatccagaataagtagaattgaaacaattaataataccaaatgccggtgagaacgtggagtaactggaagcctcacacactgttgttgggagtgtaaattgatacactttgttccttggagaactgcttggcagtatctactaaagctgaacatctgcatatcgcatgccccatcaattccattcctagcaacaaacccaacaaaatgcctacattcgtgatgcacaaaatatgtacaatgttcattacatgattgttcacaatagtaagaaaaagcaagacaaaatgaaaatcctgggagcaatccaaagatccattaatactagaacagttaaataagttgaagtaaattcattcaagggaatgaaaatgaaaaaattagggccacacacaatatcatgtgttttatttgaatctcacaaaggcaatattgagaaaaggaaggcagacccaatgagtacacacaataagatttcatttacagtaaactcaggaacaggcaaattaatctctggtgttagaaactgggagagtgcttacctttggggaactgaggttagtgaatagaagggagcatgcagactttatgggggtactgccaattttgtatctagttagttacatgagtgtgtttacttagagaaaattcattacacctacctgtgctcttttcaatatgtacactatttccagaaatgttaacagaatgaaaataagagataataacagggattatataccagagaatgacagttaggtagaaatattaactttagcgttttcaagtcaattatacatgtttttacatatataaaagcaagaatcaataatcttcctaggtagaaagcctggagcaaatgtatttcctatctctctctctgtctcgctcactcattctttttctctgttatggtgcttgtttccgctttgtttttagagagagttgaaatcagcacaaagagcttattcttgtcataaaaataaatacagaaaataagcagaaccccttcccaaacccttccctccacatatacacaccaaactttcctgtaaagaaactttctgcatggaactaatgaagttcataactataatggtttcagaagaccaaataattgaagttaattttctttccaaacatacagattttaattctttgtggctcttcaagtctatctaatacctcccagagaaaattctcataatccagacactaaatttctggtttggcaggatggctgatttgcttctctttgtagtgtcttctatgtatacacaacactgtgtcatgtgtcatgatctctttgattcctttgtgaaggaatcgagaacagtaagcaaagcctcatgttggacttcaggtttgggatgtgttagaatcactttttcatttttcaaacagcttcaggggtaagaaactatagatgtaggagctgtttcagacaatgcaagtcacactaacctttttttttttttttttttttttactgtatatacagtcggccctctgcatctgtggattcaaccaatcatggttaaaaaatatttggaaaaagaaaacaataaaaataacaatacaggccgggtgttgtggcttatgcctgtaatcccagcactttgggaggccaaggcgggtggattacctggagtcaggaattccagactatcctggccaacatggtggaaccccatctctgctaaaaatacaaaaaattagctgggtatggtggtgcatgcttgtcatcccagctacttgggaggctgaggcaggagcatcgcttgaacctgggaggcagaggttgcagtgaagcgagattgtgccactgcactccagacagggtaacagagcaagactccgtctcaaataaataaataagtaataacaatacaacaatttaaaaatacaaatttaaaaaccaacacagcataacaactattcaactatttacatgcaatttacattgtattaggtataataagcaatctagagatgctttaaagtatacgggaggatatgtgtaggttatatacaaatattacaccattttatataagggacttgggaatcttcagattttgacatccactagggcaggttggtggtaagggggctgtcctgggaccaacttcccacagataccaagggacaactgtattacatatttatggggcacggtgtgatgttttgtcatatgtctacactgtggaagacagttacctttttagagagttactggaatgaagaattcaggttggggcagaaaaaaatcctaaaatataagcaataagtttgtcttaggttttaatacagccaatgtttttaaaaagtaattaatgacattaactatcgctgtttcccacattaaccatattttatgacaattcctaaattatttaaaactttttctcaccaaccatgatacctacagaatgatgcgtgtttgaagttcagatgggtaagacaggttctcattgcaaaacggtttgacagcaagagaatctctttacaaataaaagaagaaaagctcaacagagaagtttgtgaattaaagcagatagcagagtacagcgtaatattcagacatttgcttcatcctgattagttaccttttcagagcaacttcttagtttaccagattataaattcaccattcttaacatcacagtcgaagttacttgcagaccccatctgaataattgaggctctgtattttaagtcaaagtgattagctttattttcttctctaattaaaactacttattttattaaagagagacatttctattttcatatttttcttaaaaggggcatttccacatgccctccccccccacacacacacacacctcttggcttttaaataccctcttgctttgaatttgattctgcagtgaacctgcagataattaaaccatgcatactttctgcactatttgaaatgtatgcataatttttttcaattaaagtaccttcttttttagagccctgaatattaagggcacacacccagtatttaaaatcatttgtataatgaatactgagtagaaaaaggtatatcattttgatcttagttaatcattctttgacatttacctccaatccggaatgacaaaatcttgtaccttagaattgaaaggtagtaattatattagcaaatccagggagatcaacatagtaacttatggtgatttttttttaggtttaattactttagtggttattattccctctcctctctcctctctctctctcctccctttcctctctctctgtcctctttcctctctctctttcctctctttcctctctctctctctcctctttcctctccctctctcctctttcctctctctctctgtcctctctttcctctctctctctgtcctctctttcctttctctctctgtcctctctttcctctctctctctgtcctctctttcctctctctctctgtcctctctttcctctctctctctctcctctctttcctctctctccttctcagcagaagacacttacttgtagtgtatactttaaagttaactcttgattttgttcttgaagtggtccaggtcaaatcttatttgcgacgtcagtgccttctagccgaagaccatcagagacatagttatggttgaaaaaattgggtttattggcccaaggtaatgaggaagacagtacatgataggaaaccgtgaggcagctcaggaagagggtgtgagaagagtcttcttataggatatgggctttttggtgattttgtgggggaattcaaggaagcatggttttcctgagggtcggttgttctcaaaaggcaaggaaaagtctatgattataatcttaatttttatctacaaggtgagcattctaaagagcaaattttgggctagtagaaaatacatacaatttatttttatggctataaggtgatacatgaaactacgagtaaggagctcttagtgagtgcagcagacatcttacagggggaaagaagattcagggctggaaagcatgagaccttgtcatttggtgagtggttagaaggaccactggatggtcccatccagtgcaattgaagtgatgtcctttctgctgaattttgaaatattaatatatccagtctctaggctgtagcccagtaacatctatttttgcagccatgaattgaatgccttgttgcagtccattaatatttgtaatagtgtacaaaatatcatctaatttatgaacattttccacacagatggccattgcattgcagcagaaaatcttatgatcatacctattaatatttctctattgatcatagatctcatgctcagaaatagtattgactacaattgttattttcttttcattatccagtgccacaatttgaccactgggagcccctttaggttggttccctttgatactactccagaacttttgaaagcatccttgcattctcataacaaaataatcaagacgcagctttgttctttctagtagattgctagagtctactaaagattttcatttgcactctagaaatggggctgccacatgtgattctaagtatatatgcagttggaattccaccaaattccagaaagggcaatttgtaatcagtgagtttatcatcagtgctgtcttcatttgattgtggtttttaattgctgtaatccttgaattttaattataaatgctgccaatttagcttcatcattattaatttggcttgggaatagttgtttgttcaccttacagtgagtagggatacatttttgcatcaacaatatttttatgtataattttccaataactagaagttaagatgtatatgcattgaagttcaaatatgaattcattgttccttcatttcttgggaagttggattcctaaacttcaaaaatgtacaaggactctcagaatcttgtttaaagactcatatttctgaaagttaataatgagattcatatacattgccaacaaaaaatttttactacaagttatttattttgcttctctataattcttggtaatcatagaattctttttcattgtggaaagtgggatttcataggaaagatgggccatagactgaaaaagttgaaaagactgctcttagtgaagtctttctcaactggaacctcataagtaccagagtatgttgggtgattttataaaatatgcatatgacttcccaccagcaattctggcaagataggcatgtgtattataaaaactgtctccctttattactctttccaacctcatcttcctttcctacttacctaaccttgagagtcaccactgttcttagtgtctagtccctaaaggttatgaatagctgttaagaatagtgctcagtagaagcaaagatcagcaatatgtgatatctttataaagaagggaggacccactggctatttatgcaccttcaggctataggatatttcagaataacattcctggagccacagatcaaccttatgactgtaaagttctttgtcttctccctctgactcgatgtcctttttaacaagtagtgtgctacagatcagttaccatggaggaaagaaatatccctgtggctcaggattacttgacattgtgtgaccaggagagataaacaacagggtgttttttcctcccagcagtcatgttgtacaggtatttgactgtagcacacgtagactgcccttgcgtgcttttatgtgtccacatattcaaaagtacagtgatattagctctctcttatcctgtaatatgagctactagacataagaatcacaaaatctcagggggagagagagagagagagagagagagagagagagagagagagagagagagatagatagatagatagatagatagatagatagatagatagatatagtatttgattcgcttatacatctgcagttctactgactccagctgggcttgctcacaaatcacacatctgtggttggactgggtggcttactgaactcagctgggcaatctcacgtgtctgagattggtcaacaggtcagctggactttgatcaaagatgtggctgggggtagctctgcttcacactacaggtctgtgagttggctccaaatacttctcattctcttccttggatcactgagggtctgacctctttatggcgtggtggaggcacaaaagacttttgcctagactgggaactggcacaccatcattttcatctcattctgttggccaaaacaaatcatatggccaaattcaaactcaagagttgaggaaatacaatacaacttgatattgttaggctttgtgtccccacccaaatctcatcttgaattgtaatccccataattcccacgtgtcaagggagagaccaggtggagataattaaatcatgggggaggtttcccccatgctgttctcatgaaagtgagagtctcatgagatctaatagtttaaaaacgtctggcatttcccctgcttgcactcacctccttctgccgccttgtgaagaaagtgcctgctttgccttctgccatgattgtaagtttcctgaggcctccccagccatgcggaactgtgagtcaattaaaccttcttcctttataaattacccagtctcaggtattcttcatagcagtgtgagaatggactaatacacaactctatagagggaagagttgcaaagtcacatgtcaaagggcatggatacaggaagggaacagtgaagaactagaaccaatgacagctaacacatacctcttgcatttttctgtgcatgacacgtgtaatacaaatggagaagtccagttagtaataattcccactctgattgagaagacaacaactaagtcggaaagggaggatactgaagttattaaagtcacagagccagctagaaaccctgaccaagattcaaatatcttcttatgaatctggcaactttgaacaagtggattcctctgaggattagtctttccaactaaataatgacaaatataatagcacctagctcgagggttgttttagcattgaatgagataatgcttgcaaattgtaagagttcagagtatcgaatctgtttttttctctttcccttcctctcattactcatctttccttctcattttctttcttctccttccctttctttttttctcccttccccacctctctttctttagagtatgcctcttggttgttgtgctccatcttgaaccagctcattttacataaagtactatcgtcaaggtcttattaaagtatttttcttttaaagaaaacttttcaaaagaaaaattaaaaataatttcctaggtttggcccttgagtctgaacagtacctctgaaatgaaagcaaacataaaacaggcctctcaaagctactgaaaaagtcactgggtctttgagctcagcatagctcacatgttactgtgaaggaaatactgattttctgtattcccaaccatgaacttgcatttgtggtaaccatggcaactacccaaattgtgaggtcttggtaaagccaacatggcaaatttatattaaattaaattatattagacaagggggtatattgtcagcataaccatttatgtcctctgaccatcccgtacttaataattaaaagtctttctttatatcttcctctggtccagatgttctcaaccttggctgcacattagaatcccccgggaaacttataaaataccaatgccaagggcccatctatagagatgctgattttactaggtttgagaggagacccagacatcagtatttttttaatccctcgtatgattctaatgcgcagccaagattgagaactactgctctgacctaatatataccaccttatttgagatattctaggtagagacagtctacccaaaggtaaatataacaatctcctcaagtggttaatcagtacaaatgcatcatacaacccaagaaaattttgaaatagacaccacagggaaagcaaaagtggtattgtataaggaagagtaggaccaataggaaacatgtctagataaaggtaggctgcagtgtactgttctagaagaattagacttaggaatcagatctttaactctggccttagctcaggaacaaataactaactacatgagcctggaccagtcgctgcccttctctggaccacatttacctcatctgcaaaataagaggagttgattcattgatttctaattcccctcctcttctaaaatcctgtgatgtctaaaatacaaaaatcttaaagcatgctattccagggctcctcctcaaaccaaataaactagagtctccaagagtggaatgtggatgtcagtagtttttaaatgttcccaggtgattctaatatgcagccagagttgctaacagttaaactttaagaacctgccatggtgtgattgtacatggtatgggaaagaaggagagaataaagactaaagtctttcaagaaaaatgaatgggataaaaatcagtaacatttttgtagtttaattaaaatctcatatttttccatctttcttttgcttcttttgtttttaccatattcttggaacatggttcagtatttgttttccctcttctctcttaaacctgccttactaagacatttcactacaatgaatatttcatgtgaggaattgagaaagtgatcaaaagcggtattgcttgggaaatacagcttacaagatctgctaggagagatgtcaccaaaattgtaatggaatatattttatttttattttcagctgtgaagatgtgtgctttcagtaagtgtatattagaggtaactcactgcaaaaaaggccagcatctataaaaaagaaagagagagagagaatcacaggtcaacagactgaatttagtcagaaggtaaaggcatctgttttattacataaggttgttggaagcgtggtagcttagtccagcaaaatactgggcatgtggcctgttgtctggtgggcaaagaacaacaacaacaaaaacttttccaggtgcactacattaacttccaacatcttcctaatgtcttcctcattcttcccattgttcaccctgtttcaggaaacagttctaagagcttgcccccaaaaattacgtctcccaaaagtcctgtctagagctatgataccccaaacagtagccactagccccgtgtgcctatataaatttaaattttaatcaactaaaattagaaaagtaattcttctgtcacactggccccattgcacattctcaataaccacacagagttattagctattagctatctttgatgtcacaggccatatccatcatcacagaaagttctgttggaccgggcttctctagggtctcagcagtacaaaagccaagcttacttgctaaccggaggtaattcagtgttattttggaaaggttgagaattgaaattaattctctgtgtctcagttttctcctccaaaaaatggatataagaataatgatcagttccaaaggaagggttatcaaattatatttaagtttcctgagtagcataattctgaataaaaacatttatacatggaaagcaactatgtttataactcataatctgggaaaaactaaagcatagtatatagaaggattgccagtgtttctcaaaatatagtccatgtgccacttcctttggtctcccctgcattgcttgttaaaaatatacatttctgtgccttacccagcattgctgaatccgaaaattcggagtggaaccgatgactgggcattttaatgaatccactgactatgcttatgcatactattgtttaaaaaaatgcctttttggaaaaataatcatttctagcccatcccagagccttgtactttgtgagtacatcttaatttgactaattgaatttatcactcttttggtcagttggtgttttgcaaacacatttgggaagtaagcagtttctccaacagtgagattacagccatgatcctgtggggagagttaaattgcagtgtattttacactcacttctgtgactgggcagtaccactgaattccggtaatattatttagcgtagctgtcataaattggtcatttggggctagccaaatgattacctaggaagtatttcacacagtttcttaaagaagctgttgcaattggaaacagcaggaaaacacagccattaaaagagaaaaaatgcctatgtttttacaacaaaataattagaagccattactggcgctgcttagatttcagtatcccatctatcttactttcaattagaaacattgtgcccaaataggaaaagtctggctaaacatgagtgcattttgactgcactgtttaataaagtgggacccccattgctaataaagtctgttgaaattttcttttaagtacaacttttttttaggtagtactagtttttgaggtagagagctaggtagcaatttcactaatttatatctctctatccatcatgataatagaaactcaaagatggaatttgtgagtgtgttaaacccagcttctactcaatgtctgaatccctctcacagttttcccagtgaatgatggcccccatccccatttgaacacttccaaaaatgagataatcatttcttccagaggaagccattcccacgtggggatagtctttgctagtccaaaaccaaaatcatttggttttagttctgccctcttggatcatatagcgtaaacccaatgcctctttacatgacaacttttccagtagtggaaaattactaaggtgttccccttgtgaactccattgagtgttcagaaatattttcttttaattaacatattccagctttcagctaatggtgatgaaaatagaacaaatcattatacatttcttctacttcagagcactttcgtatattacacatcttaatttagacaagacttgacaattcatagttgctaattcaaaaagacttaaccaagaacagagattgtcttgactaatggatattcttaagaaaatatatccatctcatctaaactctagtagtctatctgttgaagctagcaaaatctcaatttttatttattaatttagcatatttatcaaatgtccaactgctacatgtagggactcaaccatgaaccgggagctgaaaatttagggaaataaacatttagatgcctggataatataagacttaagcatgttctctttcatttattagcactcacttgaaggagtggaaggaaggcagtcaaaacagcagaaagggtactagaccagttgtcagggaaatctaattttgtcacgctacccctaccttataaatataccaactggccttcagcaagtcacatagcctgacttgtctgcattttctgtattttgcttacctcgtgaatttgtgattttgttttgttttaatcggttgagatggttcttgtcaaatggctttcttattaaagaggatgaagcatagtatgctagtatatatatgctgtcagtgtacaaagtacttctcaaacattaatccttaaatattttaaaagatttgtgaatagttatgccattcatgaggtaaagaaactgcaactaaaatgggataggcaatcaatttaaaaatcattacagtgaactttatcattatcttttatgtaaccatttccaggtggtttcgttaatgtctgaaaaaaattttgttttggctcaaagtcaactccattgtctactttgtagatactaaagctaatttgattataatatcgaagaggaaactctttaacagctttaatttttttacaatagtaagctgttgtcaatttccatggtctttgccaaagtgatcaagtaagtaattttatgggtcatctcatgaaacttgtttccaatttgacattttgcctcctaccattttaaaaatagctgctgaaatacaaatatcagaaagaaaaaaaaactcttgaattagcagtttgatccccttctttgctagttcccttttcccagaaatatactttgtaatgttttagttgagttttaagtgtctcaattggtggtagatctggcacttccttggtagcatatttcacagtctagtgatcttaatagctttaataccttgaaatgtgttaaatccagtcttatttgtttgtgtaatttaaaattttccataggcctcgcatcaccccagcaaaaacaactctttaatggtctcaacactttttaatggctcaaattttaccttttgtttttagtgtttaaaaagtttgaaatgggcattttagtttgtcccacaaaggccttcagtggttatacccaggatcactgtcagcatgtttggctcaacttaatattacaactttcttctcttgtctcttctgagaaaaattaagttgattctatatattcttattcaagttcaataattaaactaatacctatagatggctcttgtttactacataccaggtaatggctatgcacttcacaagggttctcccaaccttgataaggggctgtcctatgcattgtagaatgcttagtataatattacagcatccctggcctctactcactagataccagtagtacttacaccacaaccccaccccattgcaacaacaacaaaaaaatgtcttcagacattgctaaatgtcccctaggggaaaaaaatcacccctttgagaaccactgacttacattagctcatttaacccttacagcatcctgtgaaacaaatgttattacctcagtttcatacctaaagaaaagtctaaaataagatatataattaatctacaggtatgcagctagaaaatggaggagccaaaatttgaatccctcttctgactttaaagttaatgattttccaactatgtaaacaaccttacttcaataataatatgcacaaagtttcactttaatgtgttttaacacattcaagttgaataacattatagaattttttgcacatttattttttattctatctgaatttttaaaatccctttacatagaggagtctttgtattatttattattcagtattttatcattgtcttctttgaagtcagaatggcttatctgattgatcaggacttcattttgtttcaattctgacttctaaaatatctgggatctctctcagctttgcctaatatgcaaatttcattagtcttttctctgttacatcaataaaatatttagtattccaaatgggcatactcttattacatgtctctttccaaaatatctttctatttggattcttgctggtatataatgcattcattccatctaattcgtagaatcctaattttctagaaagataggagcaggtgctgaggagaatcagaggaaaaggataggtacacagtgtgacagtatcagcagcggtcatagaaagagcctggattccctcatttcctagaagcacatgccttaggagaagtcaaaataccacaaaatgcaatttgaattcaattttagtcaccataaatgaagaatatgaaatacatggtttataccaaggcttgaggcacttgtttatacttacttacctattagctgcagtgatgatctgatttagatttcagaagtccagcaatggtcatatgctttcaggagaaaagaagggcaaaatttgttattttctttctcatttttcttttcttagtccatcgttttttattattttttattatactttaagttctgggatacatgtgcagaacgtgcaggtttgttacataggtatacatgtgccatggtggtttgctgcacccatcaacccatcgtctacattaggtatttctcctaatgctatccctccccttaccccccaccccctaacaggccacagtgtgtgatgttcccctccctgtgtccaagtgttctcattgttcaattaccacttatgagtgagaacatgcagtgtttggttttctgttcctgtgttagtttgctgagaatgatggtttccagcttcatccatgtccctgcaaaggacatgaactcatccttttttatggctgcatagtattccatggtgtatgtgtgccacattttcttaatccagtctatcattgatgggcatttgggttggttcgaagtctgcttttgtgaatagtgccacaataaacatatgtgtgcatgtgtcttcatagtagaatgatctataatcctttgggtatatacccagtaattggattgctgggtcagatggtatttctgcttctagattcttgaggaattgccacactgtcttccacaatggttgaactaatttacactcctaccaacagtgtaaaagcgttcctgtttctccacatcctcttcggcatctgttgtttgctgactttttaatgatcaccattctaactggtgtgagatggtacttagtccatcttttaaaatctggcattcaaagcaacccagaaaaagccaaacaggccaaaagaaattggactcactctcagctttccccctggtagccacagtcattctttctgaggtaaacactccaatttgtagcggaatgagagtcaaagggttttggagaacgttaaaaaaagcaagagaacaaaactacgactgtggaccacaaacttctgagggacatctactaaattacttcaggattataagggttttcttaagggtgatgaaaataatgcacttgtgtttggctaaattaattgtgaaatctgcaactataatatggaacaaaattcattcaaatactgggaggctgagtctgtggcataagtttcatcagcccttttctctgaccagctgcaactatttaacaactgggttaatattttgtaaatgacctgtgagtttattgaattcagtttgttttctttatctggtttgcatgtgtagtcacattcaaagtaacctcaacaactgaatggtttgggctaaaagggtacatgtccttgtagtatccagataatcaggacaaatttggggaatgagagaggtagcttgatttgtgctgttaaaagcttctgttttctactttattatgaatgtcaatagaacatatgtgtgtttaaaagactcaggagggtcgaggaaagggccttgtaggcattgtttaataacaatacaaagcccaatgttggaaaaggcatggcgaacacctagttgaaagcagaaaaaaaaaaaaaaaaggccaggtgtggtggctcacgcctgtaatcccagcactttgggaggccaaggcaggtggatcacgagctcaggagatcgagaccatcctgactaacacggtgaaaccctgtctctactaaaaatacaaaaaattagccgggcgtggtggcgggtgcctgtatccccagctactcgggaggctgaggcaggagaatggcatgaacctgggaggcggagcttgtagtgagccgagatcgcgccactgcactccagcctgggcgacagagccagactctgtctcaaaaaaaaaaaaaaaaaaaaagtggtaattcctccaaatagttaaatatagaatatgcattatttgaagtgaatatactaaatgttttacattcagattttccattttcaactgaaatatgtcatggagaggagacagtgacttgtgctatgtttagtattcaatgaactaatcatgtttccagttaataggtgtctaacctaaattcctagatatccctgtgactgtatgacagtatcacaagtgatatgaaatgcttggaagtgagttcttttaaaatttgatttgtttaccaaaatcccatgaacatttattaatgttttggtatcagatgtgtaataatcctttgtattgtttaggtgttgccaagctttgcatattttactggggctcctttttttgggttgtgattaaggaagttaaggagataaataaaatgagaagtgatttatctggatccgtacaagctagaatatctctgtagctctatcttagcaatagcacttgtcttgggttgcattcttgcaaagcagatcctgaatcaaggatttgagtgcacatagcttgtttggtaggtgatcccaacaattactgaaaggaaaatgaggaaacaggacataaaaaggaaggaagccagtagaagttgcataataggtggttaccacctgagggtagctggggtacaatcccactgggaacttctgtgagacagtggagggaacatctcagacctgttccatctaagagccaaggaggcttgtggtatttatctatccattcctgttgtcatttatggatggctgctccaggaagcctaatttcccagaatgagcctgtcctatgcacaacttgagcaatggctggagactgacctctggtagagaggcatggtgcttgtagtaagatgcccttggttcatgagtgggacagtgacagtagctgtgatggcactaatattccccaaaacatcagaagccccctttgtgaaaaatttaaatggcgggtgagaactttgtcccataaatgtgaaatccaacttccattaattgcccttaaaaaaaaagaaaaaaaaaaccaatattttcccaatgttcctcaaaacaggttatcatacaagaaaatctaaagagctcttgtaaacagattccctcaccattttattttccagctgagcctattgtatgttagtttaaaaaaaaaaaaaaaaagcctcagtggttgtgacttgcttttctgaatttgcagatgcctggggtgctccatttacacatgcactttataactgaaagagtagtcctcagagaggagtcatagcaatcattttaattagcagcaacttgaagactgtcctttctttctccccgccattaacccaaatgaaccaagagataagcttataaagttttgccacaaaggtttctcagctggcagctggtcaaattgcgcagaggcaataatactggacaactatttcctactcaggataatttttaaactgttaattacacaccagctaagaggtgagggaggtgccgtggttactaggatcattactaagttgttgtcaatgctgttcggtctaccctaaaaccacaaagacttcagaataaaaatattaatgtgctgtcagaagataaactttgaaaaaatgttctttagtctccgaagagcttatctcttcaaaactacccttaatttttcttgtcgcagagttgaagaaatccttaaatatgaagcccttttggaattaaatagaaacagaaccgacactgaaatcatgcagtgcaagaaagtaagataaaatattaaaaacacatttactcccatctgtacacttttgagatcagattttcattttagatgaagttattaggcccattccatttggcctaattatgtgtattttgtttcttttaggatgaagctttttcattttttttgttttgttcgtttgtttttttttttttgagatggaatctcactcttgtcgcccaggctggagtgcagtggcgcgatctcggctcactgcaacctccacctcctgagttcaagcgattctcctgcctcagcctcccgagtagctgggactataggcacgtgacaccacacctggccaattgttgtatttttagcagagacgaggtttctccacattggccaaggctggtctcgaactcctgacctcaggtgatccacctgcctcagcctcccaaaatgctgggattacaggcctgagccaccatgcctggacgctttcctcttactttctttggatcagtcttagactgactcttagaatggattcagatgctccaagaaaatgcccattgcatgttggtacattctcattcttctctaaaatggcctaaacacctgtaacctggatcaggcagtaccagaaggaagtggtaaggggaaggactgatataaggagcagaactctaacagctgagccctttcttgcaggataaggctttcaaacgagcttttggtgatggatttttgtaatcatccttttgtttcccaggaacaagttgtctgctgctatattttcacagtaactagtatcattttggagatgctctttttacttgcaagtcagatggcacactttaaatcttctctcttgtaaaatgccataatagagagcattatataaattcaaggcatgtacaatactatgcctaattttttaaaattttatttatctcactctgtcacccagcctggagtgcagtagtgcgatctcagctcaatgcaacctcctcctccccggttcaagcgattctcctgcctcagcctcccaagtagatgggattataagagcccgccaccacgcccagctattttttgtatttttggtagagacagggcttcaccatgttggccaggctggtctcaaactcctggcctcaagtgagcggcccctcagcctttcaaagtgctgagattacaggtgtgagccactgtgcccggctgcacaatttttatttagtaaaaatagatcatagggtcttctggttagtgtctacacaaccccataaaaacccatgaaatgtgaaacactgaagcagttaggcaagttgtcccagctttattaaaccaagcatccagcattcagataaatcatttaaatgcttgattacattgttttcacatttggttttgtgacttggcttggtggcagtaaagccctggaaccccactgattctcttaaattgtgggatttatttctgaggagcaatgttctcttcaagttacttttccaacatttccggattaattggcatagatcttgactgttacaggtctacatttattgatcattagggagataatgctaggctcatttaaagatgaagaaatgttaaaaacaaggctttatgactattctgaaatgatattaaacactgcaataccatgctgaacttgggttttctggaaatataaagtctgtgttatttttagaaaataatttgaaaattactttgggccattaaatgagatgcattaccagatattacattttgtaaacttgaagaacttggatgatctttctttttcttgtccactccagttctttttaagtgtttcaagcctacatagatttccttggcacctccacgtggatgtgcctatttcagggcagtctgatggtagggttgtaaaatgtgattagggaatttgaaagagaaggaagttggctgaaggtcgttatcaattagattaaaattcagatgaaaactaaaggctactgagctattcaaatagagtaatgaataattgttcgtactttttgaaagacatttagaatgtaatttcattgtgaattttcatttaattgaaaaatggcagaaggatcaagtctacccagacacccaaatacacaaacctccagggcaatgcaattttctaacctaaggaggagtggggaatcagttgaggcaggtgtagggttaaagtatagtttaagccatcatcattggataactcagtgggccatagaaactcttaccaaattatggccctttaactaccaatcctagtggcctcacaggcctgagaataacggagggaagttcccccctgttttcttatttactagggaaaataatggaataaccatctcctgagaccagcatttgtctcaacctaatggacggcgattaggttctttgcttatttttctaatgggctgatataaaatactaattttccccagtttaaaattttattgccaatattccctgtgagcatataagtgtataacaacaatttaattgttttgaaaggtaaaatgcagaataaacagctatccacaaaattggatcattttctcttgtattactttaattacagtcattttaacagcttcaccaattgcatctcttatttttaaaagcaaaataattgcatataaataattcaagcaacgatgtgaccgtgcaggcccagaaccatctgactggttctagtgatcccagaatgaatgatacttaatatctcttattcaactccataagcacaggtggatgtatagtaatataagttttcagcattgccaatcccaccagaagaaattgtttcacctagtaatagaccacaaacagtgggaaaataaaagagtcaaagaattgtaataaaattccccattagaaattgggaatctgaaattcagacaatgttcagtgattttgcccaaattgcacataagaatatatgatgaaagcatattatatatatctgtttatatccctgtgcctgagtgatagaatgctttgtaattagactgtgttgtgtctcagtcacaagtgcattgaagtatccaaccacatctgagctggagcttctaaagaagataaagcagtcaaatgcattcatagaaaatagaaaaactaaattacagattcattctctaaaaggaactcttcagcagctatgagtcatgaactgagaatgcattctgtgtttaattgcaagaaaactaaagccaaattaaactaatttggcattatttttagacattaaacaaataatattaaggaaataatcaacagagtgaaaaagcaacctacagagtagaaaaaaaatgtacaaaccacgtatctgataagtaggtaatatctaactgctaaggatatcctacaactcaatagcagaaaaaccaaataatccacttttaaaataggcaaaggacctgagtagccatttctccaaagaagacgtacaaatggtcaactagcatatgaaaagatgttcaacaccacttatcaggaaaatacaaatcaaaaccacaatgagctatcacctcacatggtaggatggccatttcttttctttgttaaaattcttttattctggattcagggggtacatatgcatatttgttacatgggtataccatgtgatgccgaggtttggacttctagtgatcctgttgcccaagtagtaaacatagtacttgacagggaattttcaatccttgcccccttacttccttcccaccttttggaatccccagtgtttattgtttccatctttatgtccatatgtacccaatgattagctttcacatataagtgagaacatgcagtatttggttttctgtttctgcattaattcactttgaataatggcttccagctgcttccatgttgctgcgaaggacgtaatttcattcttttatataactgcatcgtcttccatggtgtatacgtaccacattttctttctttcttttttttaatagcgtctcgctttgttgcccaggctggagtgcaatggcacgatcttggctcactgcaacctccgcctcccaggttcaagtaattctcctgtctcaggctcctgagtagctgggattacaggcacatgccaccacgccaggctaatttttgcattttagtagagacaaggtttcaccatgctgccctggctggtcttgaactgatgagctcaggcaaccacattttctttattcaatccactgttgatgggtacctgggttgattccatgtctttgctattgtcagtagtgctatgatgaacatacaagtgcaagtgtctttttggtagaactttgcttttcctttgggtatgtactctgaaactagaaaaacttttcctaatcaacatggagtggataatatattcactgtcttatttgcagaaatttgctgtcaataaataacacagctgcagtagaaagtgtatagtgttttgtaataaattgcctgatgttaatatataaatggaaaaaaaaacagtaatgggattgctgagttgaatagtagttctatttttagttttttgaaaaatctccaaactattttcactagggctgaactactttgcattcccaccagcagtatataagcattcccctttctccacagccttggcaacatctgttatttttttgactttaaaaatagagaatgaacattattttcaaaaacaatagtagcgagtgttggagaggatgtggataaattggaatccttgtgcactgttggtgggaatataaaacggtgcagccactatggaaaacagtatcaagatttctcaaaaaattttaaatggaactaccatatgatccagcaatccaactactgaatatttatccaaaagaattgaaatcaggatttcaaagagatacttgtactcccatgttcattgcagcattacacataatagtcaagctgtggaagcaacataaaagtccctcaatgggtgagttgatagactgtgttatatacatacatgcatatgaagtccagtgtatcagtttgttctttcatggatcatgcttttattgtcgatgtaagaagtctttgcctaacccaggatcacagagcttttctcctatgtgttcctttacaagttttacagttttaggtttgagatttaggtcgatgatttatgttgagttaatatttatatataatgtaagatatgtataaaattttatatttttgcatacagatattcatttgctccaacgtcttttattgaaaaaacaatcctttctacaatgaattgccttgcaactttgtgaaaaattagttcgagtgtgggggtctctttctggactttattccacttacttgtttgtctctctttgcagtaatgttacacggtctgacataattatagtatgactaagactttctcataagtcttgaaatcaggtagttttagctcttcaactttgttcttctttttgaaaactgttttgctcattcagggtcttttgcatttctctgtgacttttagaatctgctcgtcaatttgcaccaaagagcatgctacagttttggatggggttttgttaaatctgtagatcaattgcagagaattggtatcataacaataataagtcttatgacccataaaggcagtatcatgtctccatttatttagatctccatttatttctctcaacagtgttttgtagttttcattgtactgatcttttacatatttcatcacatgaatcctaaaatatttcatattttcatactattttaaatggtattgtttttattttaatttctgactttttattataaatacgtaaacattttgtatattgatcttgtaccagcaaacttgctactctcacattttagttctaataacttctttgtaaatttcatcagcttttctacattaacaatgacttctatgaataaagacagttttacttattactatttttttttacaatctagaggctgtttatttaattttcttgcctgattgcattggctggaaactccagtataatattgaatgcagaatggacatccttgttttgttcctgaacttagaataaaatattcagggttttgcaattaactatgatgctagctgtagtgttttttaaatagatgccttgtataaggttgaggaagttctctatttctattttgcgatgagttttttttttttttttaaataaccagtaatgaatggtagatttattaaatgctttctctgcacctactaagatcatcatatagtttttgttttaaagtttggtttcttactttggataatacagaacagtttaattcccctaaaaattccccgtgtttcacctatttgtccctccctccctctacccaaattcctggcaactattgatatttttactatctctatagttatgacttttccaagatgtcacagagttggagtcatacagtatgtagcctttcgagacggacttctgtcacttagcagcatgcatttaagattcctctgtatcttctcatggctcatttcattttagtgctgaataacattccatcgtaaggatgcaccacagtttgtttatccatacacctatcgaaggacatcttgggcttccaaatcttggcaatgatgaataaagctgctgtaaacattcattgcaggtttgtatgtagacatgagttctcatttcatttggataaatactagggagcatgatcactggattgtctgataatactatgtttggcttttaagaaactgtcagactgtcttccaaagtgggtgtatcattttgcatccccattagcaacgaatgaagttctttttgcttcacgtcctcaccaacatttggtggtgttagtgttttggattttagtcattctaataagtctatagtggagcactagcagggattcagatggcagataggaggcaggattagcttgcagctcccattcagagggacaagagcagcatgtggagactcacatcgtgaacttatgctccaagaaataccacaggaatataccaggaaagctgagagcatccacagatgctttgaaggaactggatcattgcggcaggccgctgtctcatggcctggggcgagatctcagccctggtgactagctgtctaaaaatagacttggtactattgcaggggcacagtgggagtgagactggcatttaggactgcgggctctgtgagacctgtgactgccagctttcccccacttccctggaaacctgtatgactcagcagagacagccataatccccctgggaatataaatccattccactgggaaccacacccccatcctcacagcagcctcagcaagccccacgctaggagaggctgagctcagacacacctaaccccgccccaccctggtagccaaagacaaaggtcataatctcttgggagctctgtggccctgcccaccgactgagaaacctgaatactaggttcttttgtcccacgggatgctcccttgggcactagggcaagtttgcatcctccctatattatcacaactgatgcgctcttgaaagcatcacctcctggctggagatcaaccatcataaaaccagcacactaaacaaaaacacagccaaggaccctcacagaatccacttcactcccctgctacctcccccagagcaggtgctggtatccatggcagcaagacctgaacacagatcacatgacaggactctttgcagacactccccagtaccagcctgaagctcggtagctctgccgggtggctagatccagaagagcaaaaacaatcactacagttaggctctcgggaagccccattcctaggggaaaggagagaacacaacatgaagggagcaccccgtgggacaaaagaatctgaacagcagcccctgaatcccctatcttccccctgacataatctacctaaatgagaaggaaccacaaaaacaattctggtaatatgataaaacaaggttctttaacaccctcaaaagatcataccagctcatcagcaatggctccaaaccaagacaaaatctctgaatttccagaaaaagaattcagaaagttgaatattaaacaaatcaaggaggcaccagagaaaggtgaagtcaagcttaaagaaatcaaaaacattatataggatatgaaaggataattcttcagtgaaatagcataaataaaaaaaaatcccaacttccggaaataaaagacacacttagagaaatgcaaaatgcactggaaagtctcagcaatatagtcaaacaagcagaagaaagaacttcatagctcaaagacaaggctttcaagttaacccaggccatcaaagacaaagcaaaaataatttttaaaaaatgaacaaagcctccacaaagtttgggactgtgttaaacatccaaacctaagaataattggtgttcctgaggaagaagagaaatctaaaagtttggaaaacacatttgagggaataattggggaaaacttgtctggccttgctagagatctagacatccaaatacaagaagctcaaagaacacttgggaaattcatcacaaaatgatcatcgcctaggcacacagtcatcaggttatctaaagtcaagatgaaggaaagaatcttaagagctgtgaggcaaaagcgtgaggtaacctataaaggaaaacctgtcagattcatagcagatttctcagcagaaaccctacaaactaagaagggattggggtcctatttttagcctccttaaagaaaacaattatcagccaagaattttgtatccagcaaaactaagcttcacaaatgaaggaaagatatagtcttttccaaacaaatgctgagagaatttgccactaccaagccagcactaaaggaactgctaaaaggagctccaaatcttaaaatgaattatcaaaatttaccaaaataaaacctccttatagcataagtcgcaccggacttattataacaatcaacaaatagcatgatgaatagaatagtacctcacatctcgatagtaacattgaatgtaagtggcctacatgctccatttaaaagatacagaagagaagaatggataagaattcaccaatcaagtttctgctgtcttcaggagattcacctaacacataaggattcacataaacttaaggtatggggtggaaaaatatatcccatgcaaatggacaccagaagtgagcaggagtatctattcatatagcagacaaaacaaactttaaagcaatagcagttaaaaaagacaaagaggggcattatataatgataaaaggattagtccaacaggaaaatataattctaaatatatatgcatctaacactggagctcccaaatttacaaaacgattactactagacctaagaaatgaaatagatggcaacacaataatagtggtgggctttaatactccatgacagcactagacaggtcatcaagacaggaagcaacaaagaagcaatggagttaaactatatcctacaacaaatagacttaacagatatttatagaacattctacccaacaactgcagaatatacattctattcatcagcacatggaacattctccaggatagaccatatgataggccacaaacaagtctcagtaaatttaagaaaatcgaaattatatcaagtactctctcagaccacagtggaataaaattggaaatcaactccaaaaggaaccgtcaaaaccatgcaaaaatatggaaattaaataacctgctcctgaatgatcattgggtcaacaatgaaatcaagatggaaatttaaaaaattctttgaactgcacgataatacttacacaacccttcaaaacctctgggatacagcaaaagcagtgctaagaggaaagttcatagcattaaatgactacatcaaaaagtctgaaagagcacaaatagacaatctaaggtcgtgcctcatggaactggagacacaagagcaatccaaacccaaacctagcagaagaaaggaaataacgaagatcagaacagaactaaatgaaattgaaacaacaacaacaaaaataaaaaagataaaagataaatgaaacaaaaatctggttccttgaaaagataaataaaattgatagaccattagcgagattagccaaaaatatatacacatacataccatggagtacttctccgccataaaaagaaatgtaaagcagtgtacactgctagggtgatgggcgcatcagaatctcagaaatcaccactaaagaatttattcttgtaaccagtcaccacttgtttcacaaaaaacctattgaaaaaaaaataatcttttaaaataagtctatagggatatatcatttttcttttaatttctacttccttttgttaactgttgtagtataaagtatttagttattgttttcttgctatgtattcagcttgtggagtgatgtctttcatcacttttgggaaattttagttcattatctctgtaacagtctttgaccattcttcctcccctttctttctgggaatcctttttattgtgtccctaaagtctctaatgctcttttctgtataatcccacattttatttttccctgattgattctggatatttttattctgatccaagctccagttaagtaattatctatccgttgcatccagttttcagttaaaacaatccattgagcttttaatcttaattatttccatttctataattcccattttaactagctaccaaaattacccatattttctttaaattctttgaatatattaacaatcgtgtatttgaaatcctttgaacaattgtatatttgaaatccttgaacaatatgcccattatatggacctctggtgagtctgtttttattgtctgctttctctgttggtttttgatcaaacctttccttcttatacatctggttgtttttaaactgtgtgttcaacgttttatatgagaaaaattaagcgataatttgtggatctggatgatgtattcttcctccagagtgcctttatttttattttgcctccatcaggcaggtactttaggggaactaggaatcccagagtaacttaattcaatcagagaatattatccaaaactaggcttcagtgtctctgagagctggaaccttccatttcccaattagagtgtagtgctttagaattctaacagaaatcctggagtatattatatggcaggaaccatccttattagtggtcttgagctcaacctcttttttttttttttttttttttttttttttgagacagggtcttactctgttgcccaggctggagtgtagtagcactatcatggctcactgcagccttgacttcccaggcttaagtaatcctcccaccccagcctcccgtgtagaactcaaacttttgactgaggatccctctgagtctattgaaagctcagtgctatctctcagtctcttagccactgcttttggaattttcaaaggcctcgaggcaaaaagcagcactaaacaccaggctcacttctctggcttttcctctctatagaatcttagtgccactaatacttgcatcttcatggttctcctatgccttcaaatagagccttttaatattttttcagattttctaattgttttcagtgagtgtcattagtttgccagaaattgaactccctttcagcctatgaataataggcataattttaaacaacatttattgagtgcttctcatgtgttagatgctaaataaaaggctcatacctgtctggcttcatataatccccaaagtaattctgggtacaggaattctcattttgcagacaaaggtaaatacattgcctaagaatgtgtatctggcaagctctagatgtgaaatttctcccatttcattctatttttgtccccacaatttatgctggatatcaccaattattttcatgataaacaagttcacctgctagaaaatacaggactcgtcacagttactgaagctgaaactttccccaatgtctagcattctagttgggtagtataatagtagatctgcttcattatttactgcaacctgtttcttttttccagtttttattgggaaagtttccaaatgcactaaagaatagagtacaatgaaatgaactctaagagacctgtcatgtagtttcagtttcctttttttttttaatgctggattcaggggatacatgtgcaggtttattatatgagtatattgtgtgatactgaggtttggggtgtggatggcccctttatccaggtagtgggcatagtacccaataggtagtctttcagcccacatccccctccctccctgagccctcaagtagtccccattgactgttgttcccatctttatgtccaatgtttagcttccagttataagtgaaaacttgcggtatttggttttctgtttctgctttaatttgcttagaatattggcctccagctgcatccatgttgctgcaaaggacatgatctcctttttgtatggctgcgtagtattccatggtgtatatgtaccacattttctttatccaatccaacactgattggcacctgggttgcccagtgattctatgtctttgcttttgtgaatggctcatagatgaacatacaagtgcatgtgtctttttggtagaacaatttattttcctttgagtatatactcagtaatgggattgctgggtcaaatggtagctctgttttaagttctttgagaaatctccaaactgttttccgcagtggctgagctagtttgcattcccaccaacagtgtataagcactcctttttctctgcagccttcccaggatttcttgttttttgactttttaatcatcatcatttcaactgatgtgatatcgtatctcattgtggttttgatttgcatttctctgatgagtggtgatgttgagcattttttcttgttcattggccacttgtacatcttcttttgagaagtatatgttcgtgtccttggcccattttttaaattggattatttattttttgcttatttatttgtttcttgtagattctagataattgccatagccttttaaatgacactctacaagttatcccctaaatattttagtatgcgtctccaaaaatgtttttgctttatattttttaaaggttctatgagtgtaccttgcttgtagcaaattgtagttctgttttttttttaaaaaaggatcagcatcctaggagcatcattctaggagtatacttaagagagctgagtatttatagtcactaaaatacgtatacaaaaatgttcatagaagctgtattcataatagcccacaattgaaaactacccaatatccaacaagagtagaatatatagtacattcatacaatagaacaaactactgtcacgtacaacaacatgaatttcatacacataatgttgaataaataagccaaaccaaaaaatacattactccattgatttgaaatactacattactccattgatttacatttcagaaacaaatagaatcaattcatgagtgatagatcttagaaaaatggataacttcagcttagaggaacacttttgggatgctggaaatgttctttattttgatttgggtgggagtcacacaggtaaatacgtatgtaaaaattcatagagtttgtaccctttgccctttcttgaagtatcacattatacttccacaaaaaagcaattttttaaaaggagccataagtatgctttagatcaggagttggcaatttttttctgtaaagggccagagagtaaatatttttggctttgacagataggatctcaatcacagctattcatttttagcgcaaaagcagccatgaatgatacataaactcatgaccctgactgtgttccagtaaaacatgatgcatgggcattgacgtttaaatttcatataatttttacttgtcataatatattattttttgtacttttcaaaatccattttaaaatatagaaaccactcttagctcatgggacatacaaaaacaggctgtagtttgccaacccctactctaaatatgtgtgtataaacatatcaggaatgtatataggaatatgggcatgagaatttgagcagttctagaaaacctggaggctgaaagtagaactgacattcacatgagaaatatttattttaggctttctgtaattataggaagaggataaaaagagccagtgttccatggtgtttagtgacagtggtcagtaacaggaatgtatactgtttttttttttttcacactatgatttaccatgaaagtaaataatgctctgggattgttttcattagtccactgtaaaagcatttaatactttcttcccattttgctttttatttacctgaaagttttactacacaaagtggtgacagtagtaatttgggatttcagggagatggcattaaatgcaggcagcttgtgcgtggaatatctcagatgaacttctctcaacagcctatctccaaagcagactccttttatgaacgttttcccgtgacttggaggtattcgcagaagtggtgataatagtaagatttgacacttatgtggtgttttctcctttcaaagtgcttctctctaagaagaacctaaagggtacattttaaatccatcttcttttcagggcagtaggaaccacaaattttagtaactccagagaatagcagtagcctctttaaaagcatatactgagtttcctaccagaaaactctgcctatgatcagtgtttttctttcaaaaatgatgcattgtaccttttaaattctgtgttttccgttcttcgattacacaaaatgcaactaattatataaatgaaactttactcacagaacttaataatctctttgtataacttgacttaagtgaatagttatattagcagaaatactgcatatctgcttaatctcgacaattatttttttcgcgctgccaaaatttatttggttcctatatgacatgtactagaggcataaggaggaattaggtaagagcttcctcaggggtctcacagccttgtgggagagagagacttgggggataggccctatctctgacctttgtagctggctctttttgataatactctcctttgggcacataggtgccagcttctgacaaccatgcctgttccaagaattgcctgggataacaccttgctttcttgaagtgggtttctcttctccctgtcactgaacccccaccattacctgctctggccttttggctttaaccatctgctgtaatttgacctctctggcttaccagactcagcttcttattcaactcagctatacatcttcccttgatttcagccctgaggcttcaggagaaaggattacttcattagtcctagacccaaaggaccatgatagcctggctgacccctgacctggcgagaaggttctagacatatattacaagtagcaataatataactgagttgaataattgcaacaagagcacagaggaaggagccaaacttccatgtgtggctattggtaattgtctgagccaatttaatgccttcctcagagaatatcctcatacaaaatagagaaaatataggcaataatgatgtttttggcccctgttggcagactcaaacatataggaagcaagttttcctgcatatatataagcaagcagagttttaaatcttacagtctatagttcactgtcccactgataattttgttgattgctatattaaatttttgaaatctggctcccttagtttttgaataggtgcctgttctcatgcttcaagctcaggaagtctcttagatctgaaaaactgtttttcttccatcaacacagtctatttttcattaagctgagcagggtggctgagccagcgaatagagcatccgaaaggataataacagtgaggtgttctctttgtgggactacatcaattcaagcaggaaaatcaatgcacctgggggaagagtagactagtattccagcatcattaatgctcagaaggtggcaaaaatcacaacgaaaaaaaacctgactcaactttcttcatgcagagaaacaacaggtgaaatggctaagcctcagtcacttagaagagaaggtccatcggagaggcattaccaggtttacttttagcaactctagctactgaaattaaagtcacatatttaaagtactctgggcttttaaaagacatttccatctttgtttttcatcacacttactttggaaggaaagctagatagtgatattttatttgctttcccgctaacagcctacaagatggggagttctagaaggagaaagttgtgtctttgaagccagaaatagaccttttttgagagaagggttccactcagttgctttgctcactgagctgtgcaatttctgttacacaaatccttagactttgaaggtctccctgttcttaccactactgaaaaaaaactgctttgaaagcaaataatcccgtgtcaactaccccacgttaaatggaaaaaccacagagagctcggaagaattacgggagctaagtcagcctcttctagaaatgtgtaaagtcctcctagaaaggagaaatccttctgatagtgcccattgtattagttagctatgctactgcaatgctgagtaacaaattcagccaaaattctgtggcttaaagtctgcaaattggctctacctcagctaggctaggatggactccatgctctaggtatcagtctccaggtttaattcaggtgtattcccatgttgccacattttccttggaccagaggctacctgggataggctgttctacccctgttctacaagaggctaaacacagacatgtaagcaaatttaaagcccatgtgtctgtcatagctgttactactccattggccaaaacaaagtcaggagctaaggaaatacactcagccgatcttgaagacagggaaagtatgtggatatatacggaaggaaatgaagtattatgagcagtgtcccaatctacttttccctccaaatggaaggaatattctctgattgggactagatgattgctatagtaatagggagtatttctttttggccagtgcaggaaaacgtatctagttgttcacctgactagcctcattccatttattaaagctgatgggtattggctattttcatgggtagtcatgcaattcagctaagctgaaaagaggggaaatattttcttgtgtggcttcaaaaagcctaaagctagactgtccattatggtaaccacttgtggctatctgaatttaaatctaaattaattaaaatgaaataaaaactcagttcctcagtcacactagctccatttaaagaactcaatagcctagccagagcaaattaggcaagagaaacaaaagccttctatattggaaaggaagaagttaaattgtccttgtttgcagataacatgatcttatatatagaaaactctaacaactccagaaaaatctgttaaaattgataaatgaatttagtaaaattgtaatatataaagttaacatacaaaaatcagtagtgtgtctatactaacagcaacctatctgaagaagaaatcaagaaaacaatctcatttacaatcgctaaaataaggaataaatttaatcaaggaggtgaaagatctctacactgaaaactataaacctttgatgaaagaaattgaagaagatacaaataaatggaaagatatctgttttcatgaatttgaagaattaatattgttaaaatgtccatactacccaaagcaatctacatattcaatgtaatccctatcaaaataccaatgacatctttcacagaaatagaaaaaacaatttgaaaatttatgtggaaccataaaagaccccaaagagccaaagcaatcttgagcaaaaaaaaacaagatgccaaatgtactcactgaggaaaggatagtccctcaataaatggagttgggaaaaccagatacccatatgcagaagaatgaaaatagaccctaaatcgtaccatatagaaaaacaactcaaaatatattgaagacttaaatgtaagatcccagactatgaaaattctagaagaaaacatagggaaaagctttattatattggtctggggaaacattttttggatatgacaccaaaagcacaggcaaaatatagacaaatggaattacatcaaactaaaaagctctgcacagcaaaagaaacaatcaacagagtgaagagacaacctacagaatgggagaaaatacttgcaaactatatatctgataaggcattaatatccaaaatatatcaggaatccaactcaatagcaagtaaacaacccagttgaaagatggggaaatgagctgaatagacatttctcaaaacaagacgtgcaaattgccaactggtgtgtgagaaaatgctcaacatcttgtgtggcttcagggaagtgcaaattaaaaccacagtgagatgtcacttccttcctgttagaatggctatgatcaaaaagataaaagataacagattttggctaggatgtagagaaaagggaactcatgcgcactgttggtgggaatgtaaatttgtacaaccattatggaaaacaatatggagtttcctcaaagattaaaaacagaaccaccacatgatccaccaattccattactggatatatatccaaataagtatgtcaaagagatatctgcattccattgtttattacagcactattcacaatagacaagatatggaatcaagctaagtgtccatcaacagaagaatggataaagaaaatgtgtgtgtgtgtatatatatacacacacaatagaatattaatcagcctttacaaaggaggaaacctgtcacttgcaacaacatagatgaacctggaggccattatgtttagtgaaataagccaagcacagaagacaaataccacatgatctcactcatatgtagaatcttaaaaagtagatttcatagagctagagagtagaatgggctggggagtgatattgaggagttgttggtcaaaggatacaaaatttcagttaaacaggaggaataagttcaaaagatctattgtataacaatgtgactatagttaataactatactgtattcttgacaaatgataagagagtgggtaagtgttctcactacgaaagtgctgactatgtggggtaatgcatatgttaattagctagattcagtcattccacaatatatatatacttcaagacatcacattgcactttgggaggctaaggcaggtggatcacttgaggtcaggagttcgagaccagcctgaccaacatggtgaaacccccatctctactaaaaatacaaaactagccgagtgtggtggtgcactcctgtaatcccagctacttgggaggctgaggcaggagaattgcttgaacctaggaggtggaggttgcagtgaaccgagattgcaccactgcactccagcctgggtgacagagcgagactccgtctcaagaaaaaaaaaaatatatcatgttgttcatgttaaatacatacaattttctctgtcaatttcttaaaattaaaattcatgcataaaatctgccaaatatgctccacaacactctttacatgcttatctttagtatgttttttttttttaacaacttctcgttttccttgatggaaccttccttggaagtagaggctgtgtgttttctcagttacccccagcatataggaagtgaccaaagattgcttgtttaataaaacaaaatgattaagcaaagagatggctagaatattgaagatgcttacaaacttttatatcttattcaaaacatcaaggaaatctacaaatttcacaaaacaattaagtacccaatagccacgtgttgcttgtagctaccacactggatggtgcagctgctatttattgccctcacagcacaaatcacactctaaattcttatctgtttgtatgcctgtttactttctctctttccctcgggtggactaaataataaccacctagaatgtgtgcctcctaatccccagaacttgtgaatactaccttatatgaaaaaaagggactttgtacatgtgattaagttaagcatcttgatctgggaagattaccccagattatctgagtgcacccagtgtagtcacaaagtttcctgtaagggaggcagggggatcacagtcagacagagggtgatgtgatggtggaagcagaggaacggagagaaagagatttgaagatgccacattcctggctttgaagatagaggaagaggccgtcggtcagggaattcaggcagcctctagaagctgtaaaggacaagggaacagattcttccctagagcctcccaaatgaacacagccctgtggatctgttttagacttctcacctccagaactaaaagataatacatttatgctgttttaagccattaattttattgtgctttgttgtagcagtcatagaaaactaataatactcctcattggagcttaagatctatgagagaggaaccttgtctgtctcattcactactatatctacagcaccaaatatagtgcctctctaagagcgggtactcataattattggagaattaatacatgtatggataaaaggctaacataagccctaaaaggccctactaacataagacaccttccataatcatgtgccacagatcctaaatctctaccatgttgagtgaggtgggtagagaggtggaggagaggaacagaggaagcaaggaagaaaggaaggaatgaaaggagggaaggatggagggagggagggcaggggggccagccagggagaccaaatcctttgtaatagacacatcagtaacaattagcaagcgtcatacactttgaagttgcagttcacctttatattctttatctcatttgaattgcaaccacccatgttaagtgagcaggcagttattaatcccatcggcttacagaagccgaggctcagacatattaactgtcatgctcgtggtactgcaactagaaagtgccttatgctcaaatctcgtgatttgaaacctaggtttctttcccctatgctagaaatgacatcatgtgcaaaataattgggaaggcacgggaaaaattcaccctttctgtttcaaattcaatttagcacgtttctgctcagtttgagtcaaggtatctggcaattttcaagtcaaagaagacaactgcaaagagaagcaggcctcatacagactggctaaaatcagatcatacagtccttgtatacacaatcaaatatactcccatttcagaacttagaaacacggtgtttgttgaagagcaaactgcttttagtgagatattggaaagcaaggaagtatgatttttaaaaaaaaaatacaaattttagtatatatatttgtccaatacaaataaatggttatattttaaatggtgtataagttgctacgttatagtcttgattttgcttcttatcctgtgaagcctaaaaatatttaccatcttgcccttgaagtaaaagtttgctgaacccttttctaggtaaaaagttggggacaagtacttcctattttttcctcatccctaccggagaagtaaagagtgaaggcccatatcagcactttgttctaatgattttctatccacttctctgtgattcagctcctccctcattcatacagagaaagtttttaatctcctctctatggaggaacaacaagaagctaaagaagtgttcaattttttttttaatgaaccaccacaaagtttcatagttttagtttcatgaaacaatcattttatcatcatcatcatcatcatcaccatcattatcatcatcatcaatgtcttatagttaagatggttgattgggctaaactatgtgattcctacttggggttctctcagtctgatggtggctgaggctacagccatatcaaaagcttcctctgagatgtctggtacctaaactagaaatgcaaacagcttaggggtaaaacagctggggtatctctatctctatgtgatccttccacgtggtttctccagtatggtggttttgggttagccatacttatatggttgctcagggcagaggagagaggaaggagggaggagagagagacactccaggtggaaactgtactgcctcttatgatctagccttggaagtcatattgcgttactgtaatcattttctattgtgaccatatctaattaccacaagcttagtgacttaaacaattcaaacttattatttcacagttccataggtcaaaagtccagatgggtatggctggttcctcgactccttgtccataaagcttacatcagggtgtcagccagcctgaaggctggaaattctgggggaaatctacttacgagatcatgtaggttgttggccaactttaggtccttgcagttgtagggctggggtttctgtttcgttgctggctgttagctagaggttattctcagcttctaaagaccacacacataccctcactcatggtccccttcatcttccaacccagtcatggcaggccaagtccttctcatgctttgaatatctctgacctctctctctctgccttttctgtcctactctagctggagaaagttctctgttttgagggctcctgtgattggattggcctactcagataatcagggtaacctctctatttcaaagtatgtgaccttaattacatttgcatagacctctttaagatgtaacctaagatatccgcaggtcacagagattaggtgtggggatcttccaagacattatacctaccgcagttaattctattgcattctatttattagaagtgagacagtaagatcagtctgtattcaaagggaaggcagttaggctccacttgagttgaggaaagcatcaaagaatttataaacatattttaaatatcatcatatggagtgttatttcaagcacattatttataccaggactttagtttttggaagcgcaaaagtcagaaattaacatccattgtttgtttatttttaggtcctagtatttagccacattttaaattaaaacatgacgtcatgtacttacaactacatgtagagtcacatatagttgtaagaagcaaatatctaataaatacttatgaggtcatgtacttacaactacatgtagattcacatgtagttgtaagaaataataccaagaggtctcatgtgcccttcattcagtttcccccaatgttaatatcttggcaaaactataatgtatcacaagaagatattgaaactgatgcagtccacagtcttattcagaatttttcccgcctttcacctttttttgctttactgaattgatcttctttccttagaacacagaggtgaagatctggtttgaaggctggggaattgtggtaaaacaaataaaggtaatgcaggcacacaaaaaatagtaacacgttgatgaacattttacaaattctactatatctatgctttatgtggcagatgaatgagactattaggatgaatgaggaatgcctcctactttcaaaggttccatgtttaatggaagaaatagactgacaggattggctaactttccaccaaaattcatactcctccttccgtggtagagaattgtccaactcccttatattaaggtgagatcatgtgacaaatgtttgccaatgcaaggtaagcagaagtgacttgtatcacttctgggccaaggtagttaaatgaaggatatgtctccttctaactctcttccctcttagccaaactggatattgacatcctagcagatctttgcttcagagatgacagagcatccattagccagagcatccttgaatgattgcttggaacagatgtccctaaaccccactaactagacctgcattagactgttatatgaacaaataataagtttcatctgctgaaatgtttaggattctctattatagttgcaatacccaaattaatacacagacctaggaacaaataacaacaatacaatgcgaagagtactgtgatgggtgtagggcgtgatgggaacacagagctcacactgggtaggaagatggcagagaagtcaccaaaagcatactagagaagaaattgattttctggagagtgtgtaggtgataggtagcattttaagcagagggaactaaatgtacacaaacacacggatattcagtaacatattagggagtattatatggtttagtagagctgaaatagggtgcattgagaggtaatagggagggtgggtaattacagaaagagtgatcttgtgtgttagtttgaagtatatgtatttcatcagagtgaatatgagcttcttaacagtgtttaagcaggggctgatatgattaagcaatttgaatatgtgagactcataggaggaaaaatttttatcttatgcaacctaagataacgcaaactccagaagggcagttatttgtataatattttacattgtatctaagtagtagtactacagtattttgtctacaaccattctaagaataatttgggggaagcaccttgcttctggatgacattcaatttaggcttttaacaaaatcatcattagttcaacttcactataatggatctgaagcaaatgttatgaagacacagagtgcattaagatctttatgtaatggtcctttgcaaatgggtatgccatattcactaaatctactacgcattattcaaactcacctattgtgtcaacactttgcaaaagggagattagtattgcaaatatggaaatgtttagatatccagaataaaacagtaacacgaaaaaaggctttttaattgagatgtaattcaaatatcataaaattcagcattttaaggtgtacaatcatttgtttttagtgtattcgcaaagttacgccgcttttaccactatgtaattccagagcacttttattaccccaaaaagaaaccccatgctcattagtagtcacttcccattctcctcctcctcctgtctatggaaatcactaaagtattttctgtttctacggatttgcctattctgaacattttatagaaattaaattatacaatatctggacttttgtgtctggattcttccacttagtataatgttttaaaggcacattcatgctgtagcatttatcagtacttcatacctttttatggccaaatagtatttcattgtattgatctacatttttattgatacataatagtcgtacatatttatggagtacacggcatagtttgatacatgcatacaatgtgtaatgatcaaatcagggtaattgggtatccattacctcaaacatttattgcttccttgtattgggaacattccaaatcttctcttctagctattttgaaatatactataaattcttaactatggttgccctcctgtgttattgcacattagaacttattctttctacctaactgtatttttgtagccattaatcatactacattttgtttattcactcagttaatcacatgtaggttgtttccaccttttggctgttatgattagtaatgctataaatattcacataaaagtttttgcatatataatcacgtaccagataacgtttcagtcaatgacagaccacatatatggcggtagtctcataagattatgataccatatttttactgtgcctttcctatgtttagatatatttagatacaaaaataattgccattgtattaaaattgcctatggtattcagtacagtaacatgctttacaggtttgcagcctagaagtaatagggagtttgatcccatcctgtctcattttaggcttttacaaaaagatagtgtgcccttcaaatgtatggtatggtgatggacacccatgaagtgattctaactttgtggttgaaagttctactactgagacttcttttttaatttttttttttttttttgaggcggagtctcactctgtcacccaggctggagtgcaatgttgtaatcttggctcactgcaacctacacctcccaggttcaagcaattctcacacgtcagcctccctagtagctgggattaaaggcagatgccatgatgccgggctaatttttgtgtttttagtagagacggggtttcaccatgttggctaggctgatctcaaactcgtgaccttaggtgatccgcccgcctcagcgtcccaaagtgctgggattacaggggcgagccactgtgcccggcccactactgagacttcttgttttgaagcacaggcctctcagatcatgaaaatcattaacattactgctattacatagcagcctaggtatgtagtaggctgtatcatctaggtttgtgtatgtatactctatgatgttcacacaacaacaatatctaatgacacatttctcagaatgtatctcagcattaagcgatgcgtgactgtatgtttgagattcttttgggtatgtacttaggagtagaacttctgggtcatacggtaactctgtatttaacttttggaggtattgccaaactgtttttcacagaggcttcaccattctacattcccactagcacatatgaagattcacattcctttacattttcaccaagtgtattttctgttttctttctttaattacaagtattcttgtgggtgtgaagtggtatcacattgtagttttgatttgcatttccctaatgactaatgatgttgagcatgtacctattttccatctgtatatctttggagaaatgtccattcaagtcctttgcccattttcaagctggttatttgtccttttgttgatgagtcgtaagggctctttattctgcttaatagacccttatcagataaatgatttccaaatatttccccccattttataggttgtcgtttcacttcactcatggtgtcctttgaagcacaaaagtttacaaaagcttagttttgatgaagttcaatttgtctacttttcctttggttgcttgggttttggtgtcgtatctaagaaacaatgcctaataaaaaagtcagaaagatttactcctatgttttcttctgagagtttcatagttgtagcgcttacatttatgtttttgttacattttgagttaattttttgtatggtattaagtagtggtctaactttttttttttttaatgcccatggatatccagtttttccaacactgtttgttaagacaacttttctttccctattgagtggtcttgggattcttgtcaaaaatcaattgagtgtagatgtataggtttatttctatgttcttagttctgttccattgatctgtgtctgtccttatgccagtattatactgtctttactgtaggtttgtagtaagatttgaaatttggaagtgtgactcctccaatcttgttgttctctttcaagattgtttttggctctattgggtctcttgcattctcatatgaatttcaggattagcttgtcaatttctcccccaaataggcagtttgaattttgatggacgtttaatctataggtcaatttgaggagtattgccattttaacagtgttaactcttccagtccatgaaattattttaagaagtggtgcttaactctctatttaggcctccagaatcttggctaccatcacaagctggcgtccatgttttccatagctacctccatatcttgttcattactgtgaatctggaaggactttatactgtagtgactccttaatgagtgaagtaacaaaattaaaattaactctaatatagtggtggtgaaaatgaaaaataaaacaaccgctaaggggggaaatttggcatcacctattaaaattacatatgcatgtatcctttcatccagcaatccccttctaggaattcatttttcccatttcatgtattccataaataattatatgcctactatctacccacaaaaaatttaaaaattacaaaaaaatcaatgtgaaaaaataaatttgtagcccaaacaagaaaacaagaaaaaagaaagaaaaacatcttaaacctgaaaatgagaaagcagaggatgtcagtcaggaagcagagccatgaataaagacattgctagatattcaccaatgttggcacctctttgcatttgagccaaagttatcttcaaagtaggagacaaataaagctgtaaagttatccaatagacaaatgaaaatgcaataagtatttgatctgatattccagttttattccaggtaatcagttgtagctttctacattggagtcttatatactacttcagtgaattaatattatcagttgaatgaagaaagtgagatagaattgatagtctgatgacagacactagaaattttttttttgtattcaagtgttcccaccctatcaagagtttctgctcaaagattacttgtagccaaagatatttacacagcttcattaagaaaaaaccaaaattaaacaaaacatcccaccgtatacgttcaataataaaagggatttctaaataaattatggtacacctgtaagatgaaagattatgtggccattaaaattactcatgtgaagagtgagaaaatgtgttttataattttatgaaaatgcagacaataaaattagatctatgggatgatctcaattagggaaaatacgctttaaaaaagtgtggaaggaaatataacgacatgttaacaatgttgcctttgggtagtaagattatggatacttttctttttgtactaatatgtttactattttgtggataatttttttgtaatcagaaaacagtaaactattttttaagccaaaggcatcccatccgcacctttccttctcttgtgtactatgggaatatgcattttgatctgaccattgattgtggctctttcgacaaagtgcagagttattgtgacttatggttagttcacagaggcttattatctttaggctgcccaattggtttagcagctcttcaacaatcatttattcttctagcaaatggcaccactggacagaacagtgagatcccattgactatcctaatttgaaagcaatggacgaaaaatacaaaggttgttttattaatgaaaagtgatgattgatctgctgtaaaagataaaatgttaaaatccaaaatcttacagtgttactcactgagaattccctaatgtcactattattcctagagaaagtttggtccaagctggggcactgtgaaccctgagttggatagtagcttttttctagaagccttgcacctcaccttaccaggtgtgcacagaaatagtgtgtttaatgctctttgatgtcatgagctccttatgaaaaatctagatcaatatattgcagtgataattatgatatgaattctgaaaaatttttcagaatattttaaacaagcctttctacttgaaacctatcacagttgagagagatttttgaagacaacgtgtcttcattattttcttggcttttctcaagatgacagaattttctactcatccttacattttcttttttttttttttttgagacggagtctcgctcagtcgcccagactagggtgcaatggcgccatctcggctaactgcaagctccgcctcccgggttcacgccattctcctgcctcagcctcccgagtagctgggactacaggcgctcgccaccacgcccggctaacttttttttgtattgttagtaacggggtttcaccgtgttagccaggatgatctcgatctcctgacgtcgtgatccgcccctctaggcctcccaaagtgctgggattacaagcatgagccaccgcgcccggcctcatccttacattttcaaaaggtttcaaatttcaagctgttttacattttcaacaatcttacaaaaacatttgggggtgtggctttcattgactgaatgcgcaaattgtggttttgctttagatagggtattcagattcaacagtgggcaccaggatgctacttagggttggaaatgtgtttgtattgttttgctttacttttggctcaggcagggatgaatcgggggagtcaggtggcatggccatgaataggacagtttcattattttttgagattcttaaacacatctatttggaacataatcttgaaccaaccaaatctcctgggaagtcctaccagaaatgaattcattttgcatccaaacttcaaggacataaatttataaaattgcaaactgaacattgcttttggcccgttaggcaacctcagtaagaaatgtgaaagggaaacaatgaaccttcaccatccctaagctatctaatatgctttttttctttggatgatttgaatcagagaagtggtacattgcagatgattggatcactttgtaatcccaaaatttgattttcattgaatttacatacattgaataaactttgagtgaaagattgtccatctgtgatgattgttcataaccgaagtatgcttgcattacaatgtcttattcaccattgtatcacctgcggctagcacaggacctggcataaagaagtcagtccttcagtaaatacttgcgaagtaaaggaactttagttgccttggattttaaaaggtagcctgaagacaccacgacggagataatcagaactgtgctgacataaagcttgagagaaaatcacaaaagaaaacaattctaacattgtataggaaagtcatcacctgaaattggagaaatcccacgaatggtactagctgcagtattatcaaggacattgttcctggtaagccctttaacccctcttagttcactcacttgaaaaatgacaatgttctagatctaaaatgctgtgattctttctgagtctccttctataaaccttgcagccttctctatggaccacaacttacttgaaacaactgaagaggtttctcttgtcactttcctctcctaggctcaagctactacactggattttttgaagatcacatctgtgttctattttcactgccccttcatatgcagaaaatataagactctcttgagccatcctaattaggttataatgcaaaccctaaattggctgcactcttctgttttttgcccttcatgctttattagtctcttttccactccctacttgcaaagcagtttcccaggattgagtctggagtgatgtttagaataaagcctcagtaaatttgaattctcatcgttggccttaccaacatagtttttaaaaaacaactcacagaccttaagcaatctcagtaagtagcttaaccaaatcagttctaatatagcttttaaggtgattgcatcttctcaaactccaagatccaaatagatgagattttagaaatctcacaaaacggtctagtggcctctcaagctaaacctggagtacctatcaccttatttgtgactaatctagtgcctgatatatacaagtatattgaatacatttatcaccttccagagagaaattctcggcagcattcatctgctgtttctgtttccttatctgtgaggagtttttccccctctcatttgctttcataactcttttcctcacacactcatataaatttagatactgcatgaaacaactaactctgactacaaccataaaaaatatagaagcagagaatacatcccatagagataggaactttgtatgcataaaaaattatgtatgactgcgaagctaatggttaaatttgttcagagatatgatgacactggaagaccttaacagcaggaacaagatgagtggaatcaaataccaattaaacagaatgactctggagtgagatctaccaaataatttactttactggttaattagcagctagaatttgtagatgttttttgagtccatgtattatttatttggtcctcacaactacctatgaaggcaagccaagcattactattatcccagtttcacaaatgacaaagctggggcctagaggctcagtgtttgcctaagattgtacgaccagaaactgataaaaactcagatcttctaactgaaaagtccatcatctttccaatacagtacattgaatatgattagccaaaagttaaactaaaccattttttttaaatcctgctaaaaattcttctaaagtatattcatatacttgcttcagaaaaatagatatgctaaccatatgtaagtccttttatcatatagatataaaaaagccagaatcctactatgacaaaaaagaccccagtttgttattattatatatgagtttcattttagtagagatgttaattgaaaggaacgttggggtggagaaagagcggtgagtttcagtgcaggtatagctcaagtatgccactgacacagcccatatcccaatcagataaatttattgcagccagcactgcaaatatgtccttttcttcctggtaactatgcctccatgtgtaatggagtgaactctgtttctttttatgtcaaattcctgcttactcttaattttcgacccaaatgctgcttccatctaaattcccataatttttatctgtaacatctttttgaacttaacacattgactttgaagttatttggtgtacatatcataactccttgatcaacagaggacagaattatttcttctttttaatatcctcgggggctttacacataatggtattccttagattcttggaatctacatttaggtagatgtgggatttaactaggatgtggttttacagtgacacataaagcaatgaataaatggaatccatagaagtgtatttgaggctgaaaattaagaaaaagaattaaatgtgtattcacttgaaaataatcctcagaagttgcacttaggaaatagggaaaggttggtaataacggtaagttggtgcaaagtaactgcagtttttgccatttgttctgttgtaagattgctcgggtttgaatgctatctctagcatttactagtgggattgtattgggcaagttgcttaacaactctgaacctcagtttcttcatctgtaaattggacataatatctatctcatcggattattgacaggattatataaataacatatgtgaagcaactgacactatgcctgacatatagtaagcattcattacacatttgttagttagtagtattaagagtagtaataatagtagtaaatactgcctggtgcctttttaaaatctcaaaagttgtaaataaaatgaaagaataaactaatgttaaaggaaataggggaaattggaaggggaagtagatgatgatttctaataatcaaaaacacaggattttattgcaatctagaccttaagctgaatttttattgatatataatattggtacattttatagggtgtataaggttttttgttacatgcatagaatgcgcaatgataaagtcagggtatttggggtatctatcaccttgagtatttactatttatatgtgttggaacatttcaagtcctctcttctagctgttttgaaacatacaatacattgatgttaactgtagtcacccaactctgctatcaaacattagaacttattccttctatctaactgaatgtttgtacacattagccaacttttcttcattctctatgcatacacacccttgccagcctcagatatctatcattccactctccacctcgatgagatcaacttctatacttcccacacatgagtgagaacatatgagaacatatgttctggctggctgatttcactaaacataatgacctccagttctatccatgttgctgcaaaagacaagattttgttttttatggccaagtagtattccattgtgtatatataccacattttctttatccccattaatctgttgattgtcactcaggttgattccacggctttgctattgtaaatagtgctgcagtaaacatggggttgcaggtatccctttaacatactgatttcctttcctttggatgcatacctagtagtaggattgccggatcatatgggtagttctatttttagttttttatgaaatcttcatattgttttccataatggctgtactaatttacattcccaccaatagtgtatcataagagttcctttttctctgaatccttgccagcatctattattttttgtctttttaataatagccactctaactggcatgaaatgatatctcattatggttttgatttgcattttcctgatgattagtgatattgagcatttttcacatgcctgttggccatttgcatgtcatcttttaagaaatgtctatatcctttgcccatgttttaatgggtttattacttttttgctattgagttgtttgagcttcttgtatattctggatattactcctttgtcagatgaatagtttgaaaatattttctcccattccacaggttgtcttttcactctgtttcccttgctgtgcaggagctttttagtttaatatcccatttgtccatttttgttttcgttgcctgtgcttttgagatttagccataaaatctttgcctagaccaatgtcctgtagtgtttcccttacattttcttccagtagttttatagtttcatgtcttatattaagctttttaatcaattttgaggggtcttcttgtgtgtgtatggtgagagataggggtctagtttcattcttctgcatatagacatccagttttcccagcaccatttattaacgagggtatccattccccatgtatgttctcggtgcctttgtcaaaaatcagttggctgcaaatacgtggatttatttcggggttctctattctgttctattggtccatgtgtgcctattttatactagtaccatgctgtgttggttacggtagccttgtaatacattttgaagccaagtagtgtgatgcctccagcatcgttccttttgctcaagagtgctttggtattcaggcactttttgggttccacataaattttagtattgttttttattttctgtgaaaaatgatgttggtattttgatggtgattgcattgactctgtagattgctttgggtagtatagtcattttaacaatattaattattctaatatgtgagcatgggatgtctttccatttgtgtcctcttcaatatctttcatcagtgctttgtcattttccttgtagaggtctttcaccccccttggttaaatttattcctaggcgtttttttttttttttggccgttgcagatgagattgtcttcttgtttttttcagctatttcattactggtgtatagaaatgctactaattttttcatattgattttgtattctgcagctttactgaatttgcttataagatctaagagtgttttggtggagtcatcatgttcttctaaatgtaagatcatgtcatttgcaaagaggaacaattggacttcctcttttccaatttggatgtagttttctttttctttctttctcttgcctgattgccctggctacaactcccagtactatgttgaatatgaatggtgagagtgggcatccttgtcttattccagttcttagaggaaaggcttttagctttccctcattcagtgtgatgttagctgtgagactgtcatatatgacctttattatgttgagatattttccttctttgcatagtttgttgagagttttttttttttatcatgaggcagtgttgattttatcaaatgctttttctgcatctatgagatgatatggtttttggcttcattctcctgatgtgatgtattgtgtttcttggtttatgtatactgaactacccttgtatgggatgcaatctcacttgatcctgttacattatcttttagttaattttattattttaatttttttagagacaggatcttgctcttttgcccaggttagagtgcagtggcatgatcatagttcactgtaaccttgaaatcctgggcttaagcaatcctcccacctcaacctcctgagtagctaggactataggtgtgtaccaaaattttttaaaattttgttttgtaaagacagagtctcactatgttgcctaggctggtcttgaagtcttggcctcaagcgatcctctcaccccagcttggattacaggcatgagccaccatggccagcttgtattatctttttgatgtgctattgatttcaatttgcggtagttcgttgagtatttttgcctctgttttcatcaggaatattggcctgtggttttctttttatgtcatgttcttgtttggttttggtatcgggttaatgctggccatgagcaatgagttggggagaattctattcaattttttggaatagttggagaagaattggtgttggttcttctctataagcttggtagaattcagcagtgaagccatctggtcctgggcattattttgttaggagactttttattactcattcaatcttgttactgattattattgattattgatctgttcaggttttctagttcttcctgattcagtctttataggttgtatgtgtccaggaatttatccttttcccctaggttttccagtttgttagtgtatagtcattcctaatattctctgatgatcttttgtatttctgtggtatcatttatatttccttttttttgtttctgactttgttaaactgaactttaagaatcctagtctcctctcctttgtcccactttttatttaccaaataaatcaatcattcccccatatcctacttcacaactctcagggagtgccctattgtagagtatcaaatccacgtcatgtttccagtaaaaaaaaaaaaaaaaaaaaaaaaatcatttaaaatcagtttgttgaaaccttttctaagtctgcagcattcacttgtctacggcacagatggccccaactcacatcagcctcaacagatttatttactgtccccctcccccaagtgccagacagataaacctcaaaggacatgggactactgaccttttaaatggatagcattttaaaaggattctgagttatccacttactctacatcaaataaatatgctgccttcatcctaactcctgatggatacaaggaaatgagtaaaagaaaaaaaatctttgcccacagccaagaaagaagagaaaatgtccaagatcttttatctaaagggagtgaatctgactttttggttcactttggagattgctaaaagatactaaaggaagaaattaacaactaattgtccctcaggagaaaggtaaaaaagcatgaaagaatctagggcaaatctttgtaaagaagtataggagaaattgggcattttggataattagcttgagattatactcctactatgagctttcagacttttcacatgaataattcccatcttggtagggcatcaaatctatcactagaatatataatcttgataagtagcaatgtttgattgtattgaaaactctttgcttagaagcatcaatcaactggcttttcaaaggcatggccaatggtacacaagttcaaacttgaactcagaatgtcctgagtgcatacactaagcccagccttgctctttgcttattagacttttttcatctggaggagccaactactacattgttacttcttcttccttgtgttcctgtccccaccctggagccccaggagttatttgatctattgatcatagtttgttgattatgtgctttcatatctgtctatttccaaagtaacattgataacaaaatacgtaatggagcttatatgttgtaggtactttgatcagtgaaatggattaaggcctgatttttggatcaggtactttgatcagtgaaatggattaaggtctacttttccttaatttatgaggacattctgggatcctctgaaatatccacaaaacagtctggtagcttcttttgagcgccacactctccagcatttccagtagttaccatggtcacaggtggaaagaggttaaaacatcttatatcattctgttgtgatactttctagcatataaactctttctccacagagacatcatcagcatttatttggtctaagaagacagaacggaaattcctatgctagtttaaaaaaatcatttgaaaagttaaactgctctacagcaatgagaataagaaattatagttcctccacaataacatatgtgaatctcaaaacataatttgaaagaagccaaaccgcaaacaatatatacaatatgattccacttatttaaagtttagatacaggtgatgcaaatatatagtgttagaagtctgcagagtggtcactcttgagggggaggtgagtaaatggaatggggcatggagggggattctgggaagcttgttaaattgtttcttgatctgggttataattaagtgggatttacttggtggcaattcaaccctatgcttattattacttttctgcgtatatgttacatttcaacaaaaattcactaacataatataactaaaggaaattttagtttactaaaaatattttgaatgttctatacaaaaagtgatacattaataaatcatagataaaaataaaaaggttttaacaagttaaatgggaagctatcgtacccaaaaagtaagacaattaggataataggaaaaagactgggaaataatacagtgaggactacagtttggaaatgcaatctattttataagcgaggaaaataaattccatgcagaaatttaagagaaagaataattccaaactgtatagaatttgatcaaacatcaaaccacttcattttacagactgagagacagagaaaagctgtttgttcaagctcacagagctggtcactggaaactataacccaaggctcctcaggcctctctccctctttgtacaagatgaggacaacagttgagctccatatcacaatacgacttttcaacacgacgacagatctgataacatggaaggttggagtgcaggtggatggctgctgctgtgtaccttttcagattccagcgctccagactttggggatgttccaggagtgactttcccaagactgtaatgagttatgagaaggcatgggaaagcaatgtcagctcctgctgaaacttcaatggcagagactgagtcaatcgaagaatagcaacacttgaacatctggaaacaccagatcccaagaatgagttagcctcattttaaatataaagaaatttccagagttgactagagttggctacgaggaataattttaaagattaaatgtcagggggcagacctcgtacacgtctgtgaatactgtatacttctgaataggccaaagctccctctcagaagtctcccacgggagaaaaaaaatgaaataaatataagaagccattccatttcctttgttccccaagcaataactgacactagggaattcaaatagatgaggttaagtaaagagaggagttagcagtaggagacttaagtcatatggcagaagaattaatttagaaggcagaatcaacagagatgaggtgacaaatgggaacaaagtaaaataagaagtccaactcaatggaaaggatgcctccagccaatcagtagaagggcactgctttcataattgtgttttggttttcaccaagtatcagggaatcactcgaccaaaggtgggaacttagaacaaccatgagatggtaatggcagagaagaaaaccttggcaacaatggtgatacaactgagaaaagcaaaggcctccattcccatctattttttgagattcttatttatttatttatttatttatttatttatttattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgtggtgtttggttttttgttcttgcgatagagattcttttttaagaaagagatttaagacccatgcattgttcatttcacaggttctattttgcattacaacacaggcagtaatcccaggccctgtgtagaataatgtcttcctagtgttccccttgagaacctacatttgctgctaatgtggggctgcatgtgatgacagcctgctagtttcctgctggtggactaatggctgcaactaagcactcctttcaaactgtgctcaaacccttgatgtggagatctcttcctttgaaagcttgtcacaattcaaggactgtggagattaagagcccatttaaggattcagccacaaaagctgaaaattatgtacttttaaggacatcagacatctggcaatgaatgtacaaaatggttgtaggttggtgtttgggtagaatctctcgaggctgggagaccaggacctgaggatgtgtgggtctctctcacagcccaaagtccttgagggagtgggccaagtgcttgggtagatcacagcttggaagtgtcaatagtcttttatataaatcatgggaattcctagaagttctgcctgctagtaggtacatgattcattacatagaattatacatccttgataagctgcaaggtagagtgccctccaaaaatgtcctagtcaaataattggccaattttttgatccttcttcaggtcatctgacatggttaccctatcctaatgcagcccctggagtcctggggtacagagtgaggtgtttttgctttgtcatcagcagcttcccaaagagtggaagagtgctccactcttgagtgctcagactgcagttatcatgcccctataaagttctagaaccgaaataattcctgtaattatctggcaaaactctacaacagtgacatatacatgtgtgtgtatgcacaaatacatgtggtataaatctatcaattagattattgtgatctgcaaaataccaaccaaagtatataacacgaggctgcttcttccaaaactcacctctcttggacagacatcctctgtaaacaacattaaaagagagaaacacgccacctggaaaccatgcttcatccttcccttatcagtgtagccttaaaccaaaacattgtcttatctggcctgtttcccaaccttctgtccacccactgtgtggttccatcactctgggaatgtcccttttgcatgcatttggctttcactgggagtctcacttcaaggatgccagcttctcatctccccaaacccttccccaataacaagaatatcgaggttaggtagacaagtgaagggataaaggtgagagcctgctataaagatatttaactgatgaagcccatatcagtgtggctaaatgtagccatataccaaaattcaatttgtatatgtctacatagctaggatacctggcaaggatctgaaatatcagtctgtgacttacgtgtcagtaaaactaccctggagaaactgtaccaactaagttcatatagtcctgaattaaattttttccaatccaaaaagaacaatacacaatgttcaagacactaaacatgagtgctttgttttcctactttttatcatttatcatgaataaaactcacattaaaaaaaaactctcttcacacagactcatccagagaagtgcccacgtatgcccttccttccagtccagttctctcttcatcaccagatgttcttgatgctcccttcacaggcatctccaaccccggcgttagtagtctctgctgtgaaattttatgaaggccttttgaaaagttagcagccaaggatctagttgtatgatttgggcaagcaacttaaacgctgttgtcctcagtttcccaatcagttaaggagggacctagggcaaattgttatcaaagtttcttcaagttttgaaaaaaaaaaaatcgaagatgttagaagaaaggagggagatgttagaagaaaggagggagaaagaaagagagagaaataattagcttatctatcttgggagctacaagcttcttcccccttaatatttttccaaattccctaagcttctctctgtcatcaaaagaccaaagccttcctgtttctctagcaaaacatataatcaagaatttattatttttatttttttaattttatttttccagaagttattgggattcaggaggtatctggttacatgaataagttctttagtggtgatttgtgagagtttggggcacccatcacctgagctgtatacgctacaccatatttgttgtcttttacccctcccactcttccccctacgtccccgaagtccattgtatcattcttatgcctttgcagcgtcctcatagcttagctcccacatatcagtgagaacataggatgtttgattttccattcctgagttccttcacttagaataatagtctccagtctcatccaggtcactgcaaatgctgttaatgcattcctttttatggctgcatagtattccaccatgtatatacaccacagttttttaatccactcattgattgatgggcatttgggctggttccatgattttgcaattgtgaattgtgctgctataaacatgcgtgtgcaagtatctttttcaaataatgacttcttttctgctaggtagatacccagtagaggcattgctgaatcaaatggtagttctacttttagttctttaaggaatctccacactgttttccatagtggttgtactagtttacattccccccagcaacgtagaagtgttccgtgattgttgcatccatgccaacgtctactgttatgggatttttttttttatggccattcttgaaggagtaaggtggcatcatattgtagttttgatttgcatttccctgatcattagtgatgttgagcattttttcatatgtttgttgaccatttatatatcttcttttcagaattctgtattcatgtccgtagcccactttgtgatgggactatttgattttttcttactgatttgtttgtgttcattgtagattctggatattagtcctctgtcaggtgtatagattgtgaagattttctcccactctgtgggttgtatgtttactctgctgactgttccttttgccatgcaaaagctctttagtttaattaggtcccagatatttatctttgtttttattgcatttgctttgggttcttggtcatgaaatccttgcctaagccaatgtctagaagggtttttccaatgttatcttctagaatttttatagtttcaggtcttaggtttaagtccttaattcaccttgagttaaatttgtataaagtgagagatgaggatccagtttcattctcctacatggggctagccaattatctcagcaccatttgttgaaaagggtatcctttccccactttatatttttgtttgctttgtcaaaggtcaactggctgtaagtatttgggtttatttctgcattctctattctgttccattggtctatgtgccttttttttttttatgccagtcacatgctgttttggtgactatggccttatagtatagtttgaaatcagtagtgtgatgcctctagatttgttctttttgtttagtcttgctttggctatgtgggctcttttatgattccatatgcattttagaatttttttttctaattctgtgaagaatgatggtggtattctgatggggattccattgaatttgtagattgcttttggcagtatggtcattttcacaatattgatcctacccatccacgagcgtgggatgtgtttccatttgtttgtgtcatctatgatttctttcagcagtgttttgtagttttccttgtagaggtctttcaactcctttgttaggtatattactgagtattttttttttttttgcagctattgtgaaatggattgatttcttgattggattctccacttggtcactgttagtgtacagaagagctactgattgtgtacattaatcttgtatccggagactttgctgaattcttttattagttctaagagctttctagaggagtctttagggttttcaagataaatgatcatattgtcagcaaacagtgccagtttgacttcctctttactgatttggatgccctttatttctttatcttgtctgattgctctggctaggacttccagtactatgttaaagaggagtggtgagagtgggcatccttgtgtttttccatttctcagagggaatgctttcaacttttccccattcagtattatgttggctgtgggcttgtcatagatggcttttattacattaaggtatgtcccttgtatgtgggttttgctgagagttttaatcataaagtgatgctggattttgtctaacgctttttctgcatctattgaaatgatcatgtgatttttgtttttaattctgtttatgtggtgtatcacattattgatttgcgtgtgttaaaccatccctgcatccctgatatttatctttttgatatgttgttggatttggttagctactattttgttaaggattttaccatctatgttgatcaaggatatcggtctgtagttttctttttggttatgtcctttcctggttttggtattagggtgatgctagcttcatagaatgaattagggagggttccttctttctctgtcttgtggaatagtgtcaagaggattggtaccaattcttctttgaatgtctggtagaattctgctgtgaatccgtctggtcctgggcttttttttttgttggtagttttttttttttaattagccaactgatatatttaaggacaaaattacatgaatacaataattgttcattatttgatctttaaatttaaaattttacatattctttttttaaattttattattatactttaagttttagggtacatgtgcacaatgtgcaggtttgttacatatgtacacatgtgccatgttggtgtgctgcacccattaactcgtcatttagcattaggtatatgtcctaatgctatccctcccccctcccccgaccccacaacagtccctggtgtgtgatgttccccttcctgtgtccatgtgttctcattgttccgttcccacctatgagtgagaacatgtggtgtttggttttttgtccttgcgatagtttgctgagaatgatggtttccagcttcatccatgtccctacaaaggacatgaactcatcgttttttatggctgcatagtattccatggtgtatatgtgccacattttcttaatccagtctgtcattgttggacatttgggttggttccaagtctttgctattatgaatagtgctgcaataaacttatgtgtgcatgtgttttaattgccatttcaatcttgctgtttgttattggtctgttcagggtatctaattcttcctgatttaagctaggagggttgtatttttccaggaatttatccacctcttctagattttctagtttatgtgagtaaaggtgttcatagtagccttgaatgatcttttgtatttcagtggtgtcagttgtaatatctcctgtttcatttcttagtgaggttatttggattttctctcttcttttctcagttaatcttgctaatggtctatcaattttatttaccttttcaaataaccagctttttgtttcatttattgtttgtattttttttttgtttcaatttcattcagttctgctctaatcttggttatttcctttcttctgctgggtttgggtttggtcttttcttgtttctctagttctttaagttctctagttctctagccttagattgtctgtttgtgctctttcagactttttgatgtaggcatttagggctatgaactttccttttagcaccaccttttctgtatcgcagaggttttgataggttgtgtcatttttgtcattcagttcgaataatttttaaatttccatcttgatttcgtttttgacccaatgctcattcaggagcagattatttaatttccatgtatttgcatggttttgaaggttcgttttgaagttgatttccggttttttttcactgtggtctgagagagtgcttgttataatttcagttttcttaaatttactgaggctcattttatggcccatcatatgctgtgtcttggagaacgttccatgcactgttgaatagaatgtgtattctgtggttgttggatgaaatattctgtatatacctgttaagtccatttgttccaaggtatagtttaaatccattgtttctttgttgactgtctgtcttgatgacctgtctagtgctgtcagtggagtattaaagcccaccactattattgtgttgctatctatctcatttcttaggtctattagtaattgttttataactttgggagctctgatgttaggtgcatatatgtttaggattatgatattttcctgttggacaaggccttttaccattatatactgtccctctttgtctcttttaaccactattgctttaaagtttggtgtgttgtttttttttttttgaatatttcagaaatattttattagaaaagtaatgtacattcattgtaacatcagcttttatttctgtgtactgtatgagcttcccaaaacctttctccaaagttaaccatttaaaactcattcatgtattttattatgcatcctacaacaaagactaagaagtaggcaagaatgactataaaacacagcctaattacagaaaagttaatctatttttacatgaaaacattttgataccaattttgtgtttattgaaagatttttctcatgcatattatccgagatttttttctgtcagagtattagttgcctaggattgctataacaaattaccacaaactggataccttaaaacagcagaaatatattctctcaccattctggaggctagaagtgcaaaatcacgttagcagggttggcaacttctggaactctgagggagaatctgttccatgcatttttcctgtcttctgatggttgccatgatgtatcaccccaatctgtgctccagcttcatgtggcattctctcctgtgtctctatcttctcttctttttattttcctttttttttttttttttttttttcagacagagtctcgctctgttgctcagactggagtgcagtggcgccatctcaggtcactgcaacttccacctcccgggttctagtgattcttgtgcctcagcctcctgggtagctgagattacaggcacacaccaccatgcctggctaattttttgtatttttggtagagatgagttttcgccatattggccaggctggtcttgaactcctgtacctgaagctattcacccggcttggcctcccaaagtgctgggattacaggtgtgagccaccacaccagccctatcttctcttacaaggaacaccagtcatgttggattaagggcctgccctactccagtatgacctcatcttagctacttacaaccccaatgacggtatttccaaataaggtcacattctcggactctaggaagtacatgaattttgaggggacactgttcaacccagagcattcagtttctatttaacataaaaaataattcccatactataaaggatgaaaaaatgacttacgaaataggtgaatggttgttgaatatacaaatgtgatcttttattttccaattacgtacagggataagaatttttggggaatatgtctcattcacaaatatgtgttgcaggcaaagagaactttatacattcttcaagtaggattcagagaattaacctagttgcattctcttgtttctatttgaagcatattgttctccagatttttttttttctaattctgatttccctgtaggattgttcagatttaaataaagcctgtaaagcagaagtagtaaacaagcctgggtactaaagttaaatattacagaggtagataaaataagtctgaggtaaattcatgtatttaattcttatctattttgcccatacagttatgctgatatttcattcacttggatccaccaacttaaaatttgtaaccataatggagaaccttttttctgtatttgaaaaatgtttactgagcaaatcaatggtataaatatgatttcaaggatatctatttaagagaatatttatttatgtgtaccgttaatcaacatgtccccttccataccccaagtgccctttgactaattatctccaactcatccttcaggtcacaattcaagtattatgttctcatacctggtttctgacaacagataaaatccttactagatgctcttacagtaccaagtacgacttgtttgtagtatttgccactatgtccattttatattgatttttgtgattataattaacataattttcctctactaaactctataggacatgtactgtgggccatgtatattgtacttacctttgcttttctaatgacaagttcagtacttgcttgattttacctttttactttgctttcagttattgatgaataactgaataaattagaagtacatattacatataaaaagttgacatgtgaattatgaatcaatctcatcaatttgttaaagaatcttctaccaagtactcttttcttgaataaacttttacccttattacagttaccatatctttgtaacaccgttaagggagcattgattttactatattaaatagttttctatttcgaatagacttggctgaattattttgattagctcaattaaaacatataagattctaataaaagactttattatgtactaaaggcattgtgagctattattaaataaattgacatgaaatataagttttgtcaaacaattcgctgtaaggattttacatttttactttgctatatatgaacaaaatggcccatatcgtactgaaaaatctctttgaaataatagactataatttgaaaaatgaaattttatcagtataacacgtaaactaatattttaaaatttaaaatttgtaaaaagcctacatttgacaaagctatagtaattattcacaagtagggacgttaaaattcatccataatcatcatcatttgagccagagaaagactgttgcaaatatctaagttcaaaatttaggacatgcaggtatgatttgacagcttgggtttacatatttagataaacacaacatagtattatttaaataaaatttcctggccagaggaaggactgcatttcaagagtccaatgtaaagattaacacatttttccagtcttgagatgctgctgctccctgagtggaactttcatggtaatatttcctacagtttctttttgaggggaaaaaaatgctaaatgctatcacttttcagactgtcccacacttaaacctatatcaaggtgttcaggaacataacacgagtgaaggttagagaaattgtgagaaaaaaatttgaagaataagatgatggtgacttataatttgatagctcctctaagcttggctgagcaccctctagggttatcttgtacatcctgatcttgtggactaagtaccttcttgtgtatcaattctcacattaaaggagctcttctcatagagacttcttccgtgttttcgtgatctgaacccagttgcagtgttttcatcacttgctgtctaacacttaggttaaacctttctgtcgtgcttattctaagcaaacatcttttgacgatgcaatcctgtagtgaatggaaggagagggcaacaaggcaaccaccaggtctcagaaacttctgagctgtcttcagtcctgtgtagagttcattgagctcattgttcacaaatatgcaaagagcctggaaagtcttggtggcaatatgagtagatcattgtagcaagtcttttcgtgcataaatagcagagggaggaaatgctcctgtgatgatgctggcaagctgcttggttctggtgatggggtagatgctgtgtgctgaagcgattttcttggcatgcttctcttccccatatgttcttaggatagatgcaagtacctgttgatctaaagcattcacaacattagcagcagtgggcatgtcagggtacctgccaccatccatcatcatgatcctcatgtctaaggggccatctttctgaagagaaaaccctctttcgggagtatcaagttgtatggaggaacacccaagatccataagaactccgtcagtagtccctggctgcactccagccttcattaataaggcttcagcctggctgaactagcccagcatagctcggatttgtttaggatacagctctgaaagatgttcagctaatgcagaagctgttgcgtctctgtccaaggcatacagaacaacatctgactccttctgtagaatagcttttgtgtgccctcctgaaccaaatatcatatctagaaaaacctgtcctttttgtggtgacaaacaatgaacaacttcatccaccattgctggaatatgtaatttaccaatagtttcaaaatctctatcttgagatctgtttaactcctgggcttgagtttgatctgtttgctcctgggcttcatattctttatatttttctgctgtagtatgtattctttttggccagacacctaaattaggtatgccagattccaaacaacatgaaagacattctttatacattctacaaaaatatggatattgaagcattctgtaggtcaacaaatctaaggcacgaagacttctcagttggcctctaacttgggccagcgactaccactacggtgccggagaacctgaatttgcccactttaaagtttgttttgtctgatataagaatagctacccctgcttccttttggcgtccatttgcatgaaatccctttttctacccctttactttaagtttatgtgagtccttatgtgttgggcgagtctcctgaggcagcagatggttggtgagttcttatctattctgcagttctgtatcttttaaatggagcatttaggccatttacattcaatgatgctattgaaatgtgaagtaccattgctttcgttgtgttctttgttgcctgtgtactttggttttttgtttgttttttgtttttgcttttatatttttgttgtataggtcctgtgtgatttatgctttaaagaggttctgtcttgatgtgtttccaggatttgtttcaagacttaggactccttttagcagtgcttgtagtggtggtttggtaatggtgaattctctcagcatttgtttgtctgaaaacgactgtatctttccttcatatatgtttcttagtttcactggatacaaaatttttggctgatacttgttttgtttgaggaagctgaaaataggtccccaatcccttctagcttgtagggtttctgctgtgaaatctgctgttaatctgataggatttcctttataggttacatggttcttctgtctcacagctcttaagattctttccttcgtcttaaatttggataacctgaagacagtgtgcctaggcgaagatctttttgtgatgaagttcccagatcttctttgtgcttcttgtatttgggtgtctaggtctcttgcaaggccagggaagttttccttgattattcccccaaataggtttttcaggctttcagaattctcttctttctcaggtacatcaattattcttaggtttggtcatttaacataatcccaggcttcttggaggttttgttcatattttcttactcttttttctttgttggattgggttaattagaagatcttgtcttcgagctctgaatttatttgttctcttgttcagttctattgctgagactttccagagcatttcgcatttctaaaagtgtgtcaaaagtttcctgagttttttattgtttttttctttaagctgtctatttccatgaatatttctcccttcacttttgtatcattttttggatttccttgctttgggcttcacctttctctgttccctccctgattagcttaataactaacctcctgaattctttctggaattcaggaaccatgttttctggctccttctcatttgggtaggctctgtcagagggaaggtctagggctgaaggttgttgttcagattcttttgtcccacagggtgttcccttgatgtagtactctccctcttttcctatagatgtggcttcctgtgaaccgaactgcagtgattgttgtctctcttctgggtctagccacccagcaagtctacctggctctgggctggtactgggggttgtccacacagagtcctgtgatgtgaaccgtctatggatctctcagccacggataccagcacctgctccagtggaggtggcagagggtgcaatggactctgcaaggttccttagctttagtggtttaacgctctatttttgtgctggttggcctcctgccaggaggtgacgctttccagaaagcatcagctgtagtagtgtggagacggaccggcagtgggtggggccctagaactcccaagattatgtgccctttgctttctactaccagggtagatagggaaggagcatcaggtgggggtggggctaggtgtgtctgagctcagactctccttgggtgggtcttgctgcggctgctgtgggggataggggtgagattcccaagtcactggagttgtgtacctaggaggactatggctgcctctgctgagtcatgcaggttgtcagcgaagtgggggaaagccagcagtcacaggcctcacgcagctcccatgcaaactgaaggaccagtctcgctcccactgtgccccccaccaacagccccaagtctttttccaggtggagggcaagattgacttgaaaacttgccccaggctatgtgcctcccagctgtgagagaaaagggctttagttcttcctctgcctgtgaagtctgcatacccaatttgtgccctcccccaagttctggctaggaggcttctctcctcgctcaaattgttacgaagttcagctagagaattccttctccctgtggagttttaccccctgttcctctggccaccctcccaatggatccctgtggtgccaggcaggaatgggctgcttggggacccagcgagctcccagggcctttctgctgcttcctctgcccttgtatttcactcctctctctaacttgactcagctccaggtaaagttggaaacttctcctgcaaacagaccttcagcttctctagtgattcgggagaggcagtctccctttcccaccttcacaattggggcactcacagtatttggggtgtctctcgggccctgcaggagcagtccgtttccttcagagggtctgtgggttctcttgggattgctggtttcttcctgcagtggatctggagctaaaattcacaatgcaagcctccgcttcacaatgtaagcctccgcgtgctgctctatctggagctgcaatctagtcctgcctcccatctgctatgatcccctgaatcctcaagaaagaatttagtatcaattattggcctacagtataaactccttgagatcagggacaacctttttgttctcaatatctagaacctaatgttaatcctctcaattattcttaaactattgaatgggatatgatgcctctcctaaggatctttgcaattaaaaccttatctctaaatagaatgaaagatttaatctcctaataaagacattacaagggaagtggggcatagaaggtattttttgcagaacatccttccagtattcctgaaaaaaataccacattggttgacttttttgtctgaacatgaagcaggttagagtgctggaagcagatatggcgagaggaagccatcaatcctcctcccctgagaggtgagcattattcctacttgcatagcaggagcctggcagtaaagagacgggcacattcaaatggtgtgagcttaacaaaggactattaaaaggaacccaacaatggataatccagtactctgggaatagcgtataaagaagctgttacgactcttatgcctgagaaggcaagggcacaggcaatctaacaggagttgtagccttcagtagaagcagccaaccggcaatgactgggcagggaaggagatgagggaataaaaaccctgatctcattctcctctcctcctacctacctagctcttcctggggcttcattggccaaaatcaactaggggctaaaaagccagggaacccataggagcagacaataagaatcaacctgctaggacagagcaggatgggaaaaaagcagaaggtggacctggagtggcagatggaaaggatccaggcttctactcaaacagcttgctaacaagcatgacaacttccatgcaagctttggcaggacaagcccagttctgacccctgattcacaaaatcttgtattcacctctggtctccacgggtctgccctcatgagagtaagagcaagagtcatcatacctaggagaaaattgtcagggtttattgttcctttcaaagccacaaaaaagcatctctactttgtccaagctttgcctgaggtagaagatgttgtattttaaagccttgatttaagtgagaaagtctctccactcccaaaactgaatgatgtgcatggctgattccatggtcctgcccacagcccagtcacatcttaacccacctgaaagtttccaagctctttaaaatgaccacatctgccgggttctaggcctataggctcctttctgtgaagacaaaagaacttggctgtcttgtaagattggattcatcttttgcagcagcagcattctggtagagaacaataacttcccatagcttcttgcaagtgcagcttgctggaaagaaatagtgtttcctcccgccccccaacccagagggctttaagagaaaaccaactggaaagatctgttggagccacaaaagcggattctctttctccttcttttctcctttatatcttattttactttagccataaaacatgcatcggattgtagaaattaaagcccatctcagctttaatgaggccaatttctgtgctgatataatagttgacagcaatgcaggcttgtttattcttcactgaaatggatgtcccaccaaaattcacaggaatataccaagaatataatgaaataaaagtttttagaaatccgtttgaaaaatataccagaataatcaaagattctatattagtaaaaggccttaatagtacccttttgtatataaatgtagtcctccatgcttgggaaccaactgtcagaagactgtaagtttcaaaagaatgggtttaagataagccaatatgatgtcaaattttgtggagtccagatggttctgttgaacttgtctttggctgcttggtttgtggggatttttcttctgagagctaaataaacgtgggtggtagaaacatagctagcaacccaagaaatacacatgagtcactgtagtaaatgtttcagagtatgtgcccatcctgagctccacttcatcaatcctcctccctctgagaagtgagaccccgaagccacgtcgttgccgtgtctccaccacttgttgaccacagctaattggaccaaaagtagacacttaactcagggaaaccaattcagaacctatattggcagaaaaaaaaaaaaaaaaaaaaaactctttcgccattcggtattgggacacagaaaggtcagtaaaactacctataggcagtcatcttataaactgatagaaacttgactaaaggccaccatttagaggcagctatgacattccatgcataaacatggcagaagaatcagccttgaggaataataaaaaagaagccactaatagagatgagaagatataaaagaccatatactccaaagagagatatgaatacagataggagaggtctgccttgaattatgttgactttccaggtcctgtttccagtccctactgaggcctgattgtaggtattgcccttaagatcttggagatatccttgtatctattcaagaaatatctccttttgcttaacccactttggattttaccatcaaaattatgtgtggacataattaactccggaaagagcaaatcaggcatctcagggctttagcttccagaagcagtatcatgtaggcacagggattcccaaaaaagtgttgagcctggttctctaacatcaggatggagtatgtcaaagggaatctttctacagcattgaaggagacaggatgattggcagtccatccacagaagatggagttacatgaggcagctattaattccttggcactgataggtgggtagggtatgctaggggcagggattcttcaagggacttgcttccttactctgttctttttcaacgctttacactcagcagaaccccaagacgtgtgtttacattttgctgtcacccgtagcattgcctgttttatgcatcagcctgatcttcattttaaccataccaagcttatgatgttgttactgaccctaccaaatcacacttgtttaattcagcaaagataaaaacattgaagttaaatgtaaagcagtgccttataaaatatgtaacatttcctaaaaaatgacacaatgtacttttatttttcaaagctcttgcttgttgttgacgtaacatctccaggtagtgataaagtttgggttatgtgccctgtttcaaaaggctttttacgtattctgttagtgctccctatagaaatcccatgagtctggaaccgcaggtgctaataaacttatttaaatggaagaagtgaggctcagtaagtcaaatgcagccacccaatgtttttcagctgatatgtgaatgagtagggacacaaatttggaagttgtaactctgaaacctatactctttccactctagaagaaatgtagaattctgcagaatgtctaaaatgcagtctttatcgtgggaacctatttaacatgggttctcactacagtgtttctagttaataaaacatgagagtaagactatatctgactcgttcatacattcctagcacatagaagaatatggaatatgtgaaaggtgtgtgacttggggtgggcttgccagaaacaaactctgaaataagaattcatgtgaaaatggattattaggaggtgttctcaggaaaccagtagggatctagggaaatgggactaggaagggaaggaaatcaagcaaggatagtacattaattcccaaggatagtaactttgactcaatcccataggcaagttctggagtctaggtcacacctcagagtggtccccataaggggaaactgtgactggagcatttatttcttcccacctatcaatcattttttaagggatgcccacagagggatgtaaatttctaggcacttttagttattcaggcaaaatgggcctttgtcagtttgagggcaaacctttgacaatgcaacacagacgctggcttctgagagtaacagcacaccaggagtcatgtgcacagaaatgaaaaagggatccaaggaaatatggacagcacaatgatggcatctggcacagtgttcaataaatagttgttgaatgaaagaaatcgaggaagaaaggatgaaaaaaggcaggaaggaaggaggaagggaggaaagatgtaatattatctaaatatcgtagcaacatttggagatagatacatttttctccatttttctgatgaaggaactgaagctcagaacgattacaaagtttgcttaggtaacacagcttgtaatagtagagtcaaaattcaggcatgtctacctagctccaaagcctctgtactttcactactctatcacatcgagctgtcattcacatgctgcctgacctccatggaaactgccttaccacctttttcaacccaccaagagtcggctgtcatgggtgaaaatctggatcacgttgtagcatccacatacctttgtcccaagcacacatcttctcttgtgtcctaagatcttgtccatttgaaacaggattagaaaaaaagagttggacatacagatgttcagataagaagtgttgacaccattccctatgcaaaaacaatgaaacatgccaaggcctaatgaagagtccagtctcctgaactctcctggcattttcagcagactgcagttttctgagaatgtctgtgttttccagagcatgtctgctcagaatgtatgagccaaaacctcctagggattttccatcagttgtttatattgtgactggatctactcgaatgagtttattataaataagatagagtgatgggggtttttttcatgaattgagactgaaaattggttttaaatattgttttcagctctagactaactataaatggcatttagactgattgcactattagcaggtaaagggtgctgagttttaagggattacaacctgatttaatataattatgaaaccaaattataactagaggggtttggtaggcagttataagaagcagctatttccttttttgtataatactaacacatatcctattaaacatacaattttcttttaaaagaggagaaaggaaatagaattttaaatgttcccaagcttagtgctctagttgtggcattagccagcctctgctttcctctaggattcttctatctttctccaccagtctccatcacatccatccaatctgtctcattaaacgtcctaactaccctcttaactttaatttcaaaacaagactaaactgaggctgataagaggtcgttgggtctattaagggtattccttagggccaaactgtgaaatcagattgaatttcatctttaccttcctgtcttgtgccttcttaacctttcagtgcccccctcgttccccaccaagtttccagagtggtcataccatgaagaattgatgattgataatcacttaagttgtggagctgtttcaaaggcactgtcttttatggtagaccaaaattaataaataaataaagtaatgatgaacctaaaaggggcttcctgaagcttcacaaagcagtccacataaagtatgatctagttcactgcatgggctatgtaaactaagataatgcctgcttttacaactccttttaataagaaatttaacctccctgtaatggagaagatataaccttagcccagatgattactccacagaactatatctctgttaatctcccctctggacatcaaagtaacctcagctttgtcctagatgatacacagctgaccacagaaatataaatcccagacagcccagcatagttcagaaaaaccattcaacagacctgtagactcatgaggagtctacctgagtctcctcacggttcaacaaatggaggttgttttaaacaacttagctttagagtggtttgttatgtggcagtagctaactgattcaggactagtagctcatcatgtgtaagctaacattatacagagcatatacacaaaaagaagtaccctggaagaaagacagatggtgttaggctataactacatgaacacacacacacacacacccgtgatacagtgtattcctttactatttgatccatcaaacatgaaaaggatgggtttagacactgctcataatttatgaaaaattagtgccatggtttggatagtttggccctgccaagtctcacgttgaaatttgatccccagtgttgctggtagagcctggtgggaggtatttggatcctaggaacagatccctcatgaacggcttggtgccattccctcagaggagtgagttctcactcttagttcctgtgagaaccagttgttgaaaagagcctggcatctctctctctctccctctctctgtctctccctctccccatctccatctctccctgctatgtgatctccacatgccacctcccctttgccttccatcatgagtggaagcaacttaagcccctcatcagatgcagatactggtgccatgcttcttgtacaaccttcagaactgtgagccaaataaacctcttttacttataaattgcccagcctcaggcatttccttatagcaacagaaacagactaatacagaactaagacaaagttttaaatcattattcgccattatctggagactgcaaaacagcctgctttagctccccccatctttgcatttttttattattaagacattctcttcaccgtgacatccttgcctcatgtggcccggggacatatttctgcaccttttttcctatcaattatcctgagtgataaaaaagaagataaaatggtagatctgaatttatcctgaaaaatgtatattttgtgagttagatcccaagcacagcccttcccagtagctgatgcccaagaccatttgtaaggcatgccgtttactactctatgctagtatggatttccatccctgattggcaggcagttttcctaggaattacctgagtcttgcttagaggcttatctgtgtgttatagaaaagtgataactacccatatcagctgcagtaaggactatggatttttcaaacaatagcatcaaagcttgttttttttttttttttctagaaatagtgcatgcatcctgtttttttaatggaccaggcctcatctcttatccttaggatccatagttcttgaaactacttcttataatgtcatctgcaggttttcaaagtgtttttcaaatctcatttcatcttcataacaatcttgagacagacagggaactaagtatcagaaaattaaattggttttcctggggtcatgccagatagttaaatggcaaagaccatttcaccacaaactcctatttatttttcaagtttgattttaaatgctgccccctctgtgaagcctcccagactccacaggcagaattaaaggctctgtcctcatagcactttatgatattaccaggtgttgtagtttagtccctgctggaaggtggtttctccaaacctcaggaaaaccatgtcttcttcatcttatccacagtgctcagcattatacaaagagctcttcaatacctgtttagtagatgcattaattaattcacagatgatgacttttttagtacaaaccatataaatatcctctggcagtggtgtagggaagaagaaaaataacaagtctagaatgtagaactcaggtagaatcctgactctgacacttattaaatgagtcaccttggattcacctcactgagtctccatttccttacctgccaaggattttcttttacaaccacatggttaaggctagtttccaacagtgtgattacactatagtcagtgaatacaaaaaaaaaaatgagtgggaaaaaagaaaagaggcaataaaaagaaatggcagaaatagaccatgacaagtttaatcatgtaacaagaacgacaattcagaggccccataattacctttctaactttatttaatcattcagagtataactttcaaactcctacaatgtatcaaatgcttagctctgtgcatgtagttgagtgaaagcataatctctccagtcttcaatatagcatagcagctttttgtggagaggggataatcccgaatgtctcatcttttgttactgctaggacttcagtggagaaaaccatttttcctagtaacaatacttgctcagacttgactagtattttgcaacttcagtggtggtagtgatgattttgcaaaatatacagcattctccatatcagagactgtaatatacaagcaaacccccatccaatcacccttccaccttgtatacatatgttacttggtaaccacagatttagacagattcatttttgctccaacctaaggatgctcctattcttgtgctctacatctcagagaggatgaatgctgaccatgccctgggaagaataggaacctgggtaaataatccacccactcctacacatcaagcaagatattaaagagtttcagtatgactgtcatttcctctactggcagggagcgataaaggaaacatacattcctattgtctgtccacccttcagagtgatggattacctggatgggaagggatattgctcctgggctccagagaattatagatagctcttcatgaatgttaatatcaaatggtggggcaaaactgtcacagcagaggcaagaagtctctgataatccattcttcctttagtttgtgctccaaaaataaatcagcaatgtcttttaccttctcccatttcccacatattatttcctttagaaagtaagtaataacatcatccttccttcactaatggctgggttggccataatttgaggcttaaaagcaggataatgtgtttcaaacagaggttctaggaggctggacatcaacactctgttacaagagaatattggtaatagtctgccaaccagaaggttgacctggtttgttatagtggaaagttttaacaagtagaatatcataaataaagcctatgattattaatactaacgtcaaggctctaattaaaattctctgggaatggggtgtttccagaaaataattaaggatttacctgaaaacccactttatttcaccatttgcagtaaaaagttttaaaactcgtttccccctttttaaccttcataaatgtgagttactttttatcaactgaaggctgtgtagtcccctaaagtcctcattgtaaaggtgactatacttcagatggagatggaaaggcataaaacatgtgaacaatcagccttaatggatctgacccaggaccattccctggaagttgttttactagctaaatccctgatgtcaattggttttctgaccattggcctctatatcttataagtctaagcaaagcaattcccagcatttggcttcactaagctagagtttacagtaggaggaggcaattatactgttttgtgatgaatgttagcattatattagagctcaacctttaaaaaaaaaaacttttaaaagaggtttttgaaggggaacatagagtgattttcagataaggacacacatctcattaccttctgttcatctctccccaccccagcagtctttgcttaaggacaagcacgcatggctgtgaattttcagtcatcaaggctggctgcttttttggtggacaaaatattggtatagatgtcagactctgcaggaatcattaagaccatagaccaaaagtccacaaaaacatatttcctcagaaaataatcctaaaccattttggttcaacttgatttataagagaaatgaaaatattctaacaagcaaatatgaaaatttgtctttaccctaaagcagtgctatttacttgctatgaactaaaattcccaagatttgttgcacatgattcagtcagagaccagtctgctgtggagtcatttaaaatccctgctcagggagcatcagaggtgcccatgacagctgagctggatgtatgctcaggaaggggaaaataaaaacaataggactgcattccctactgcattatcaactttagactccttcatgtgaaagatcaacttgtgcctctgtaaatgtttcacttttcagatttcacctctgagactgtgagggagaatatactttcattatttgaaacagtcagtgactttttcaactttctagacacaaagtgtcaagccaatgtgactgtgtcaagccttataggtgacctcatgagaagccagaggtggaaaagagaaagttctactttcaaccatattaccaatggagagatggaaaaaaaaaacaaaacatatatatataatacatgcacatatgtatatctatatatacacataaatatccatatctatgtccataaccatatatatatatatatatatatatatatatatatatatatatgtttgtgtgtatgtgtgtatgtatctccatggtgtccacatctgtggattcaaccaaccataaatcaaaaatttccacaaggttccaaaagcaaaattttgaatttgccgtgcaccaagtactatgttgaattcacacaaacatgtaggcattgtgttaggtattataagttacctagagatgattcgaagtataaaggaggatatgtgtaagttatatgcaaatactacaccattttgtataagggacttggcatccatgaatttaggtatccaaatgaggtactggaacaaatccctcatggataccaaggtatgactgtatggtgtattggggtgtgtgtgtgtgtgtgtgtgtgtgtgtgtgtgtgcaacctgtataccctgaatccagtttatattgacagatgagctactacttaaataaccattcaccactgactgtcttcaagaattggaagctgctgtttccatgatgaaagatctaattcataatagtatactacattaaaagggaaacataccagtctagtgcatcaacctaaattaagctttagtaaattttcagacttacgtaaatcatttctgttggacctgaagaaaaattctttaatatctgatgaagaccaaatttgagttgactatcttattgcatatgcaaagtgaactaatacttattaccttaaggagtttatcatttcacatcatatattagaacttgaaaatgtataattaacagtggttacgcgatggctacatgacatcacattttttctgcttactccgaatctctctgtaccatcaccatctgggtccacagacgcttgctccacctcagccactttcatggcctaccatctccccttaggctagtgtggtttcaccacctgaaatcaatcagttacttgtctcaggagtgcttgtgctttgctttagcctctgctgtgcagccaggttaccaggcacttgcctggcatttcagactcctacactgaattcgaatggaacactactccacaggagatgggatggaacattctcttggataccaaagcgtcagggtgatacaacttagaagtgtagggagttcatgggccgggcgcagtggctcatgcctgtaatcccagcactttgggaggccgaggcgggcagatcacgaggtcaggagatcgagaccatcctggctaacacggtgaaaccccgtctctactaaaaatacaaaaaaaattagccgggtgtggtggcgggtgcctgtaatctcagctgctcgggaggctgaggcaggagaacggtgtgaacccgggaggcagagcttgcagtgagccgagatcgcaccactgcagtccagcctgggtggcaaagagagactccgtctcaaaaaaaaaaaaaaaaaaaaaaaaaaaaaaaaaggagtgtagggagttcactcccttttggacaaactcttaaccagtggcaaacaggatatgagacagccaggcacataaattctctctccatccttccttccgtggattgtttgtaggcacggtttatccaaatagcttgtatgcagacatccacagatatcctgactaagtggacacatctgtcaagcaatctgctttgtctttttctggctcattgtgatgcaccatcacacatgactttgcacggctcccctttcttcctcagtggcctgggtttgcacctccccaatgaagtaccagtgcttaatccttgcctcaggttctggggaacctgatcaaagacagttggttagaaaccatccctacattttcaaatgtatgtatttctcagccaaatagtggggcacggtccactgtatacatcattatgatgttctgagtccctaaagcattaacagccaagttgttgacatgtgttttaagtttttgtatttatatgcaacgagaaaacaatgccactccatttaaatccaaaactgccaatgtggaaataggtactgacttattgttatgctgtgttaaaagggaagagcatgataaggtcctatttcgtcttttacttaaattctatgatcacaataaaatttatgtgaaatttggagtcacaaagaatgtgaatgttttctcagctctgccacctacttagctgagcaatcttaatcaaattacttaaactctctgagctccctcctctataatgtggcacaataatacatatttcataatgctattataaaacgaccagccccgtgcttagaatgttgagtgttcaatatttggtagtaatatatgttattattgtagctttccaattaagcaagaaagaaaaagttgagtttttttattgaacttttggaagcactgtgatgaatttgaattacaaaaaggtattttgcttacaactgatagaattacaacccaaataagtttaaacaacaaagggaaattcctgactcagataacacagagagaagaatggatctggcctcaaacatcaggtctcagataccatggtctgtgccttcttaccctccatcgatcaggccctctttcttctgtgtgttggccctaatctctccttctgcagatctcttctatgatgttcaacaacatgtccaggcttacctcatgtcagtttagcaacttcagtgaaaagagaaggaactttttcccaatatttacatatcaattctatgggaagggcactaggcctctgattgtttcacatgctcgcctcttggaccaaccatagttgttagggggcttgcatcctaggactggcctggtctgatcacttgtcgaacacagtagtcaaggggacaaaatctatcatttaaagaagggagctgagaaggcttccttaagcatagtcgtgtaaatgtgtgtgcacatgcacacacccccaggagccactgcgcagggatcagcaaacttttttctgtaaaggacaagagagggaatagttcaggttttgcaggccacataaggtgtcagctggatattcttctttgttttttcatttgttttgctttgacaaccctatacaagtgtaaaaagtgttcttggcttgctggctgtacaaaaacaggccacacaaggtttgtacagtggcatggatgagaaattttgaaactatcttctgtatattttcagcttcagcaaatgagtaaatatgttgaggatgatagaagctaaatgtctcactattgggggacttacacgtatagaaacagaggatacaaaaatacaccctgtggagctgagttggaattgagagtataagtatgaactaatatgagatggattgagagattatatataatctgtgggggtggctgagcgtatatgtgtttgtgtatacagtcgtccctcggtacccacagaggatgggttccagggacctcccacataaaccaaaatctgcagatgctcaagtcgcttatataaaatggcatatttgtatataacctatgcacatcctcccatatactttaaataatctctattacttataatacctaatataacataaatgctatggaaaaagttgttatactgtattgtttggggaagaatgagaaggaaaaactctgtacgtgttcagtacagatgcaaccatcctttctttttttcgaatattttttatccacagctggttgaatccagagatggtgagcccatggatatgaaggcccaactctctgtgtgtgtgtgtgtgtgtgtgtgtgtgtgtgtgtgtgtgtgtgtgtgtggaaagagagagagagaagcacaatataaacaactggtgaatctgggaaaagagtatatgggagttccttgtactgtgcttacaagttttctttttcatgtatttcatttatttatttatttttcatttataaatattttttaaaaagaaaaacaggccacctgccagttttgccaacccctgcactataatgcaaccccaatataaccctcgcacacatgcaagcaaaacgactatgaaagtttgttcatcatggaattgatgtgttgaatacaggtataaatatttagacttttagaactctagtgaaaaggtatgaggaggagcagggaattaagtacactatttctatctagcagtcaacaaacaaattttttttcttttttgagacggagtctcgctctttcgcccaggctggagtgcagtggcgagatttcggctcactgcaagctccgcctcccgggttcacgccattctcctgcctcaggctctggagcagctgggactacaggcgcccaccgccacgcccggctaattttttgtatttttagtagagacggagtttcaccgcgttagccaggatggtctcgatctcctgacctcgtgatccgcccgtctcagcctcccaaagtgctgggattacaggtgtgagccaccgcgccaggcccaaacaaatatttttgagcatcaatctgcctttgaaatttgaaaattaacagcatattcataaattgggcattgtgttttaaagagtccaagttatgtatattttgtatatcagtgtataattaaagggaaagaggaatataatagatattctagaactttctttcttttttttttttttttttttgagacagagtctcactttgtcacccaggctagagtgcagtggtgtgatctcggctcactgcaatctccacctcctgggttcaagcgattctcctgcctcagtctcctgagtagctgggattacaggcgtgtgccatcatgcccagccaatttttgtatttttagtagagacggggtttcaccatgttggtcaggctggtcttgaactcccgaccttgtgatctacgcgcctcagcctcccaaagtgccgggattacaggcatgagccaccgtgcctggccaatattctagaactttcaaggaggcaatagacagaaaaaaagaacaaagggagaacctttatgggagtgtctatccttccctataaagtattctgaatatcaaacaacgggagtagagacagatttaaatgttttctgccctaatgaattcatttccaaatctgttttaatattagacatctttatgaatattaatgttcttgaacataagtaactacagaaaagaatattcagcattcccctccccactccacccactccctctgtcattgctcctatgcccttttaatgtcattgtctaacagtaagaggtagaacattgacgagcctaaggttattgctcaagcttaagcaagtacagcaaaataagtcaccatttaggagaatccatatcactgagtcccatttctaaagatttacctcttaacattaaaccagtggttttgaaatcagagaatctgaacttgcataggaaaaatatatctctgttttcactaatcactaactgcaagttagcatttccttgagttttaaacatagtcaacaaatcacagtggctctgtcacaaatcatacgtattttcatattatattatacatattactttttcatagtacatcatatatattatattgaagatgttgcagatatctcatatctcaaaatgtcatttctgctcatcactacttagagagttcaatagttcagatctgctgctaggtctggactattttttatatattttatatattaataaaatatatttaatatatattatatattaataaaaagcacaaatactagcatcaaatttgtgtgttaatattttgacatttgtaactgcaatgtaattagtttcctgtgtaatcctatgtattttattttattcatttaaaaacattttttgagaagtggtccataggattccacagcctatgaaagatgctacaatacaaaaatgtttaaaaacgggtgctttagataaagttgactatgccctcctacttgaaatctttttctctcttggttttctcaggattacactctcccaattgtcccttgtattagtctgttccgtgcagctatagaggaatacttgaagctggttaccttataaagaaaggaggtttgtttggctgttggttctgcaggccttacaaaatgcatgcacgagcatctgcttctggtgagggcttcattgagcctccaatcatggcagaaggggaaggaaaaagggggttggcatcacatggaaagagagggagcaagagagaggaggaggtaccaggctcttttcaaaaacaaaatcttgtgggaactaagaatgagaactcacttcctcatacgaatgacaccaagcccttcgtgagggatctgcccccatgatccagtcatctctcaccagaccccacctccaacatcggggatcaaatttcaacatgagctttggaggggacaaatatccaaagtatatcatctctctatctcactggccagtctcctttgctagtttttcctcttctctttgacttccatattggagcattctgtgcctcgctcttgggctcctttcccttctctatctgtcctctaactaggtgatcccatcccacccatggtcttaaagactattgataagctgatgactgcagagcttcatttccagcctatttttctgactcttacatcttcacttgaagatctgataggcatctcatgtttaagatggccaaaagagcacttttcgtcaccctaccactacaaaaacctgccccacctcccaaatttttcccatttcgggaaatgacaccatttttttcaaccaatttcttaaacaaagtttatctttgattcctatttttctctcatgctctctattcaaacatcggcaagtttcatcaactcaaccttcaaaacacaacctgagcctgtctgcttctatctttctcacgtgctgtcacactagttctaaccacctttatctctcacctgatatacaatggcctcctgtctcattcctctacctccattcttgtcctctaacaattaattttggatgcagtaataacaattgtctttaaaactttgaaatatttcagaactgcaagcagaaaaaagcttaatataaacatatatgtttatcacccagtaatacttctttgtaataatgagaccattatcattcatctacttaaaaccatttcattcctctctttggtatttagagtaacgtaccaactctttaccatggcttacaaggccctacatgatctgcttcttgcccatatctataacctcctgctccatcatagttatggtgacctcactgctgtcccttaaacccacaaagcttattcccaccttggaagctttgcattaactattttctctgcctgcagttctccaccacatcagcactgctgagtctttcttgtcctagcttaaaatctcatgaaaagaccttttctgttcactcaacccatggaattcactcactaatctctatcgtgtcaccctactttctctttattacattatttaaaattggatatttttgtttattactttattttcctaattaattctgtaaattccccctacatactttataagctccatgagatacggcatattgcaagccttgtgtaactctttaaccccagcacctagtaggtgctcagtaagtatctggagaaggaaagaaaggaagagggagggaatcaagaaggaaaggaatgggaaaaaaggaagaagggaggaaataaggaggaaaaggaggaaagaagaaaaggaaaaaggaatttaatatttttaagcactccatttaaaaatttgtcataaaatgatttcaagcagcagctcaatagacatttccagagggtgaaatcattccacaacacccagtaacgtaaaaaataatgtcatcctcatatcttaaagggcagaggcaattgtgaaagattatgatggctgataaccggttttccagcttaagaggcctaattgcaaagtgtgctgtccagccatctttcccccactcttgtctccattcacattaccaagctaatcatgaagagctcagtgtggtcactcactcagagaacagtgcactagatgagcagatcatcttctcgagaaaaatgagcattaacaagaaaatgtttaactggatactgagaacagaaattactcctataggtggaaattatttttttcccttccaacttttattttaggttcaggggatacatgtgcaggtttgttacatgggtaaattgcatgtcatgggggtttggtgtacacattattttgttacccaggaaataagcctagtaccagatatgtagtttttgaatccttatcctcctcccaccctccaccctcaagtaggccctggtgtttactgttcccatctttacgtctgtgagtactcaatgtttagctcccacttataagtgagaacatgcagcatttggttttctgttcctgcattaattcacttaggataatggcctccagctacattcatgttgctgcaaaggacatagttttgttcttttctatggcagcatagtattccatggtgtatacgtgcacattttattcatccaatccaccgttgatggacatctaggttgattctatgtctttgcgcttgtgaatagtgccctacaggtgaaagttctaaggccattctctctcatgttttccaaatgtttggtatcagtggattagtaggccaccagacctcaaagcaaggcgcttcctgctgcataaccagagttaggcttcctattgtaatcccccaaacaaagaagcttgctttagaaaacactggtggattccgaaatgttgaagttaggacattccccctagttggtctcagcctgggctttacacagtgacttcagaggcacttttggatacctacctagtgctagtcattgcactacatgctggggatacagagatcctggttctaccaattattgacagtgtgacttgaaacttagctttttcaacctcaaattcccatctgtaaaatgagaacaagaataggacctacctcatgggtgtgttgtaaagagaagatgaaatgatacaagtaaagcacctagtactatgcctgaggaaaaggcaatgctcaaggaatgtttgtttgcataattataaaaaaaaagtcaagaccctgctctcttggagtttccaatttagtagaagaaaatgacatataaataatatgtatgatgtgaaaattcatggtagagatctgtccacaggaaattggaatcactagaagaccagcaaatctgcagatagaaagggtcatggagaagtagtattggtcttcagaatatgctttatttttcctctcctcatcccaaacttccacatccccatttgttacccaggtaataagcatagtaccagataaaggcatccaatacttttaggcatccagcacttttaggatgtcacttaacaattacagacttaccctcaccacaccaatgtagctgatcagcatcttttgctgaagttatttctccatctcttttcacccaaagagaaatattctgttctctatcctatatcctattctaagatatcttcctttgatatttgaggtgctagggagtgaagggagaagggcaaattaagttaaaaattgaaattaaaattgtcctagatcataggatgacatgtccagaagccccagaagctgagctggcaagaagaaaaatcaagtgagccctaaagtaatgagaagtgtctaatgccaaagcacagaggcaaacccacccagaagagactcctactctctaatgcgaagaacagactttattttggcacacaaaaattattttatatatatatatatatatatatatatatatatatgtgtgtgtgtgtatatatatatgtatatatatatatatgtatatatatatgtatatatatatatatgtatatatatatgtacatttttctgttttttgaaacagggtcttgttcacacaggctggagtgcagtggcatgatgatagctcactgcagcctccatttcccagagtcaagcgatcctcccaccacagcctccatttcccagagtcaagtgattctcccacctcagcctcctgagtagctgggactacacatgtgggccaacatgcctggctaattttttgtatttttagtacagatgaggtctcaccatgtttcccaggctggtctgaaactcctgagctcaagaagtcctcctgcctcagcttcccaaagtgctacaattacaggtgtgagccgctgtgcccaacccaataattatttttaacatatatttatatattaaacaaatttttataatatattcaacagatatttaccaacaaggtaccagtcactgtgctaggccttggaggtcatgacctcaaaaaacccagatattttccctattcttaatgactttgttcattaattggtgtgttagttttctattctgcagaacaaattaccacaaactcagtggcttaaaacaagattcatttgctatctcacagtttctgtgggtcaggagtgcaggcacaatttaacttggtcttttccttattgtctcacaaggctgcaatcaagctgtcagccagagctgaattctcatctgtaggctcaactgagagtccacatccaagctcactcaggccattggcagaattcattttcttttcttttttttttttcttttttgagacggagtcgagcttcatcgcgcaggctggagtgcagtggcgcaatcttgctcactgctgcatgctgcaagctctgcctcctgggttcacgccattctcctgcctcagccttccgagtagctgggactccaggcgcccgccaccacgcctggctaattttttgtatttatttttatttttattttttttagtagagatggggtttcaccgtgttagccaggatggtcttgatctcctgacctcgtgatccgcccgcctcagcctcctaaagtgctgggattacaggcgtgagccgctgcgcccggcccaggattcattttcttgcagctttaggagtcatggcatctgggttcttcaaaaccagcaaggagagtccctagagtgagtctagtattaagacagtgttttacattatgcaacccagtcattggagtgacatcccatcatgtttttcatattccatcagtaggaaccaagtcacagatcccaagatcaagaagaaaaaaatatataggagtgtcaacaccgggagatggggatcgtgggggggggggggcgcattaaagtctgtctgacacagttggggataaagacaagtaaagaggcacttaccaaagggtacggtaaatgctttgatgatctagtactgaatgctatgtacgtaacctttactgggtgggtgggtgatagtggttaaagatttcctggaggaagaacgataagatgagatgtgtacaagtttgccatgtgtgctttggggtgtggtgagtgttccaggcagagagcctgagaaaatgaaaaacactccataagttaaaaaacaggtgcatatggccaaaccacatttcactttcttttgtatcctatgaattgttgatatctcaccaagagaaaattctccatcatgagcacagggtcagactcaataaatgtaagtactttctcaatatttaaaggggaagtcttttaatattatgttcctcagttttagggaaaaatgcatacagtgtatcttgaagagaaaatactttcattttataaactcccatcattatttaaaatagtgatacgctaagactgtggtacattcttggcacttaatgatcccagctcagatctcagttctttgtcagtctctgaaataattatcttctgaaaagaaaggccccatgggtgagggagcaccagctgttgaatgctcactgctacatgccaagagaacagccagttgcccaactaaaataggtatctaagccaggtggaattgtttattctaatttgtttattcaaattggaatgtggccaattagttttgtgaaatgtgattgcaagaccacatcctcttctatggtacttatactgaacctccactttaagaaggcccctgtaacatgaggactatagctaatgatagtgtattataatcagaatttttgctgagtagattgtagcagtcttgcctcacacagacaaaaataatgggtaaacgtgagatgatgggtatgttaatttgctttactatagtaatcatttgactatctatatctcataacatcatgctgcatacattaaaaatacacaataggccaaacgcggtggctcacgcctgtaatcccaggactttgggaggccgaggtggacggattacgaggtcaggagatcaagaccatcctggctaacacggtgaaaccccgtctctactaaaaatacaaaaaattagccgggcgtggtggcgggtgcctgtaatcccagctacttgggagaccggggcaggagaatggtgtgaacctgtgaggcggagctggcggtgagccaagatcgcgccactgcactccatcttgggtgacagagcgagactaacacttatttgttgtaaaaaggaagacccctggattttatcctctgctcaattcctaatggtgctcagaattctcagccatacttaacatcaactctagacaaatctataaaatggagcctgagagcacagtttattgagctagattatagttaaagcaaaatttatattaaatcatttttaaagaataaattctagtattcacattcctataatatctaaatggatccataaggatgccttctggtaagagaaataaattcttacctaaacaggctaaaacactaaggagaatttggtggcttgtgtaactgagaagaccatagatagtgtcagtttcagatacagtttgatcacgcctgtggctctacttctctcctaaatttaaggtaaatgtttcaggtctgcctgtcctctttttcaggctgagtcaaagggtgatttccagtaacaatcaaaatcacatgtttctttgtttacatctgacagaaagctaccttcaaccactccacaaaaactttgaccactgagctaaaaagatcacatgtaaactaatccctgtggccaggggagtatcatttgttagctgatttcatcctaggttttgcaaaggaatatagttgtatacttccatctgtggtgtgaggacccaagtcctttagctcgcgtctgggtctaacagactactcagcacctgcatctcaacatggttgtcttttctttactcaacattgtattcatatttatgaatgctaggggtgccagaaagtgtgctgagatgcatagggaatgtcaagggctcactctttgggcatcactattggacaactcagtcccaaagcaccccaaatcaaaattgcaggtcatttgccaaaccccagaactctggtgactcaaccccacagatatagcccccaaatttcccggaaaattaaactcctacttatagcaattccagggcaggaggaatgctctcacttagaccaacagactataactgaccagcttatagaataatcttggaattttatttaatcatggcatttcaagattcctttacacaatattctttttgcccctcaaatttttcaggccttcacatctctcaagatatcaaacatgatacttttaggagccaaccaagttatacataatgcatttttatgttcctaaattaacaaagtgactttagatctgtgaagggtgttaaaaattatataagctatgtaagtatttttatttgttcaaacatttccagtttccttcagggtttaaaagtttcagagaactttatatttctaagtaggcccagattgttatgtatggaaaaaaggtaccctaaaaacatgtccattttttctaaggagactcacagctggcttattttttgcgtcttccagaatactaaacaataatttgggtgtgtctatccccaaatcagagagtacctagatcttttgcttagttctaatcatcattcactgaggtcaagcagaccctgagatgaggatttgagtgtatgtagtttacttgagaggtgatcccaggaaacaccagtagaagagaagggcagtgaaactaaaagaagcagctgccaatccaaggcgtgttatcagtaagcaagtgtctgccatgagctcttgaagcttgatcctgctggggacttcggaaagagtgcatagaataatcctcagtgttgtatcatatgagggacaagaagacggggtgtttactcttcaaatcccttccatcattgtttgggggggggcctgtcccaaagggagcattaactcctgaatatttctgctttgtgcacacaaagcccccgctctgggaaaaaaaaaaaaaaccatgagcagaaagtcacaagtgcccacagaaggatgctcatagcaagcactgatccagtgagcagtgaaatacaggggcaccaatatatttgcaacaatgcctaaggccgaagaattaatatatacttcttgacaatagtcataagtatcactgattatttttgggttttaccctaaaaaatactgcattcaatgaaattccaattccttgggacttactgaaattgtttatttccatagcaaggcatcatgacagagcaaaaagccctgagtttggaatgagcagagctgacttctggcccacactctgtggccttacatacagtcattcagaagtctcagattcttcaatgtaaactgaggtcttgaggtaatgataatagaaaagacatatatggccttattacacataaggcaccattctgagtgctttacagatattaactcatataaacttcatgacactcaatgagatgaggactattattcctcttaccattttacagagaagaaaactcaggcacaaggtggttggataatttgaatgaggtgacacaggtagtaagtggtagaaccaggataggaactgaagtagtctggttccaaagctgcgaccctaaaccactaccagccttcctcataatgcagtaatctctaggtccctttcattactagtgatctgtaatctttgacctctaataaagtcaggcaagataatggtatattgatctgtcatatgttttgacttctgttgcttgacacaagcccagcttgtgtcattcatcttgtaaaataatttacaagatgtgtttatacaagctaggaataagcagaaaacatcatgtacccaacaggtcctaatatgtcccctcctgaagtggcagtctatgtctgccctaaggaaagatgtgacttaaattctttccttaagaaaattaattgtcatgtatttccagtacccttgcaaatatttcaccaactgtggaagctttagaccatcaaaagctggtcttctgacagttttattactagagtgtatcctttccaaatttaacctacatttgttcaagtaagatgccaatgaactagtcatcgtcggtatcaagctggaattttcaatttctcctgaagagtagcatggatcagctgaggtaatcatgaaaggccaatttttatcatgtctaaaagcctgatccaaaaataactcaaaatatcacttttaggtacctgaaagttccccttagaaatcatattattgtgatgaaagtgatttaattcatttataaaacagatcacatactcttttgagcctttagaggaaaatttgtcattagacatggatttttctcttacataagagaaaaagaaaaaaaaatcatggggcgggaaggaggtgagagaggaagaaagggaccaatgttgctataaaatgtaagtgatagtcattataaatagtaagaggaatatgaagtggaatatgcctttgacattctttaaagcttctagacattctgcccacccttttgagcaagaattcacttggttctttgctaactttacactgagatttgtcactatgaacagcaactaaggatgtgactccggctgtgataatatatgactcaagcacaccccttggcacgtacattggtctcttatcggatgacctgcctgactttgacagccttctctgtttcaggacaatttgcaggatggaatttaagcataaccggtcctaattccttttatccctagaggctcctaagccagcagtcttggaatggaccatgcctggcaattctcacatttctcttatcactgagactacttttcatgttccctttgatactacttgaaaatattctcaccttgacccgcaatagaaatgaaatccccatatatatcttgacctcttcttgtgtcaacccttgcagtactccctcttaagacctttctaaatccctcttgaacatagaattctatttattgtagccaccgaaaactctcactcctcctctcaactacagttatcctgatcattttttaaaaacccagttgttggtttttttcataaattcagtatgtatttctccctgtagctcagaatcaaatctggctaacgaagaacctaactttgatccccctctttcccataccactaattgagcatgttttgtatatgacttttgcttggaagatgccttgaaaggagtctttttgcaaattgaaaaaagcatgaatgttgggattggataaacttggactctaatcccagctgtatcacttacttgctatataactttaagcaagttacttacccttccctaaactgtatccttatttacagaatgaggataagtacctcctcgtaggattgttgtgagaattaaatgagataacctacagaaagtatctgtcaatggaacatacttaatataaggtagcttcctttcattacccttgactaaatgatttaaataattctgttgaatagcgaaggaactgattcaacatcgcactgagatgccaaattgcaaatcccgcaagacaacaatccccactaatcaagtcaagtgcaaataggtgggccttaaaacagttgttaccaagtatttactgatggttcactatctactcaacattgtactgatgctacagggaaaaccaaatcaatataaaacatggcctacttgtagcagaaggagctaataatctaggcagattaaatgtcattcaggcatgccttttagatagcatttctcaaacctggaagatcttcagactgatctggtttgcatattaaatatatatttcagaaggataggttccagaaacctatatttatgacaagcatctaggtaattctaatattcacccaggtttgagaggctcacttcttttaaagatgcctcattactgcacaaattaattcatgtcaagtcgcatcacaactgtgttaaaaagtccagagaggcgtacttgtctgaacattaataaatatgctcatttctcagcatcactgttttctgagggttccactgtatctgaattaacttttgaatttttgttttaaattttaaagtaattttgcaggttctggacaacggatctgaagcaaattattctaaataaagtaaaattaaacataatagaatctttgcagaaggctctcaatgacagaactaaatttatcaatgaaagaataatttacaactaacataaacaatgatgcatcaggaaatgtattaatgcaaactgtgccaaaatcttcatacagttccccatccaatgcaacttgcccaaattcctgaaacctcttcctgtaggttagatggatcccatttgtcaagcgcgtccttatgaagagaccaccaacaggctttgtgtgagcaacaaggctgtttatttcacttgggtgcaagtgggctgagtccaaagagagagtcagcgaagggagatggggaaggggttgctttataggagttgggtaggtaatggaaaattacagtaaaaggcggttatctattgttggcagaggaggaggtcacaaggtgcgcggtggggagatcataagactcattgtccagaagaaggatgtcaccaagtcactgatcaaagtatggcagggtcaagccacaatagtagaatggtgtaatgttggttcattagttaaggcagaaactggctgttttacttctttgtggtttttggctgccccagacttcttggttcctgcaggccatctggacacatacatgcaggtcacaggggttacaatggctgagcttcaactcagaggcctgacaccattttatacacagtatgttcaaaagcaaagcattgcaattagatactgcataatgttctcgtaatgtatgggatatttttaccaggaacaatgaaagtattcagaagaggacaataataaaagaatattaaatatattagtagatatcacaaattcttttttttttttttccttgagacagagtctcactctgtcgcccaggctggagtgggcgatctcagctcactgcaacctctgcctcctgggttcaaacaattcttgtgcctcagcctcctgagtagctgggattacaggtatgcgcgccaccacacccagctatttttttttttttttgtatttttgtatttttaatagagatggggtgtcactatgttggccaggctggtctcgaactcctggcttcaagtaacccacccgccttagcctcccaaagcgctgggattacaggcatgagccagcgcacctggcctgggtatcataaattctgattcgtaaagacatacattctaatgaattttttttaatttcaaaaaaggcatttctattttttattatttgtgccttatccacaaatacaaaaacaaaatatctacaagcttcactcattcactggtgtcattaaaccaacatttattgattaaatattggcagggcatggtggcttatgtctgtaatccaggcatttggggcggcagaggtgtgcagattgcttgagctcaggagtttgagaccagcctaggcagcgtggtgacactccatctctaccaaaaatacaaatatatatatataagctgggtgtggtggcatgcatctgtgatcccagctacttgggagcctgaggtgggacgatcgtttgagcctgagaggcagaggttgcactgagccgagaccgtgccactgcactccagcctgaatgacagagtaaggctccatctcaaaaaaaaaaaaaaaactgtggacactggttgttacagatgctttaagtgtccccatccgccccctcctttgttcttgtcacagccttccttacacaatattggctttcttcggaaactacttgactttccaccttagggtttttttcaggctacgctggagtacagggcaggcccacatgccaggaactaatgctccagggagcagccctcaatcccttcaataaatgaaggatgggagttggtaggtaaacattccagcttcctcaccctgtggtagaacaagtctgagaaaagttctagtttcccagaattatagtttcccagaagtccccaggagaagtgaaccccagttgcccacagcagtaacatgcttattaacacattttgcactgtcttccttcccttccttgtctcagttcccacttcctcatagagcttcttggaacccccttctaaataacagacttgcattcaaagccttgcctctgtgtttgctatggggagaacccagactaagacactgaatataggacaataaaaaagtcagtcatgcctttaagatgctcagataaagtctgagagaaagattcgaacaatatagggactgataagggctgtgtgctaatataaaatatatccagacaagtagaaggaatgagtctttgtgggagttaaggagggcctcacaaatgaggtaaacattttagctgtctgatatggcttggctgtgttctcactcaaatctcatcttgaattctacatgttgtggaagggacctggtgggaggtaactgaatcataggggcaggtctttcccttgctgttcttgtgatagtgaataagtctcatgagatctgatggttctataagagggaatttccctgcacaagctctctttttgcctgttgccatccatgtaagacgtgacttgctcctccttctgccatgattatgaggcttccccagccacatggaactgtaagtccataaaacctctttcttttataaattgcccagtcacaggtatgtctttatcagcagcatgaaaacggactaatacactgtcaaaaagtatgaggagaagttttatatctatataagaagagaattagcatttcagacaatgggatgtgcaaagcacagtacccctacaacttttctctcccacctcacctcgtaacacacacacacgcacacacatacacacacacacacacacacacacacacaatccttggttttgtatacttggagtgaagaatacactgaaaagaaatgtggaagatgaaactataaaaggaatttgtcacttggtaactggtctcccaagatggcctccagtcagtcctgcctccccataacccatcttttgtgtagtcctctcccacagtgaatctaggctagcttaattattcctttgtagccagtaaaatgcaatggaagtgacctgtgcagctcaggctttcagctttaagaagacctagattcttgggttttacacttttggcagccctaaaatactacataaggagttttgttaacctgctgaagataccacatagagaggttgagtaaggagagaccctaaagtcctagggtctctgctgagtgtaaccatccaagccaagatgccaaatatatgagttcagtcatattggttattccagccccagttgccatatgacttgagagatcccaggagaaaccggtagaatcatccaacccacagaattgtgagaaataattaaaaggttgttatttaaagccactaaggtttggatttgcttcctataccacaatagagaaccaaaacagttgccaaaatgtaaaggatcttgaaagccataatgagaagtcagctcttaattatgaacaaaagaaattaacaaagcagcaatcctgataagggtttaatgaaatagccttggagacagagaatgaggatctgaagagggaaaccaacatttatcaaggattcattatgttctaaatactttgacactcttatctcattcatcacaaagacactatgaatccccaatttatagatatagaaattgagaatcaatttcaccccaggtcaagctcaccccaggtcacagtgttagacccaagactaagcccaaggctaactggtcccaaaagccttgttattttcattactacaccatgatacctccaacaaaagtaggagggagagatatttaggaagtaggattcacaaatgtgatgaatgcctgggatgtgtccgggtcgtggagaccattcagcagtgatactggcttctactctagaggatggattattataaaaaggtacatggttgcatggtatagaattaaaagtaaagaatcaggtagaaagtaattgatttttcatataaaggagtaaaatgaatatggtgacatatttgagttttgcatttgaatagtttttgcaaaactgatggtaatataaagacatgaaaataagaaattccaaaacatcacacatgggaaggactcgaaatattctcaactcagccctccagatttcaggtcagaggctgccttattacaagctctctgaagttgtatccttcagcctttatcctagggctaggagaacttacttacctcaagaaccattgaaagaaaatatttatctccttcactttccaaagggcaggttttttagtctatcagaattagaaaggaagagttcagcaacatatttttaagaaatacaacaccaccatagtatattaataccatttttcaagggctgaaaaataaagttataaaaatgaaaactatattcaccaggaaatcattatccacacattcatccgttctgaagcaccagaggcaggatagagaatattcctgtgagggccatggacactcagaaggcaaaaaaataaaagctttcgttagaagcagtaactttatttttattgtgttttagaatgaaatgaagattacatattccactcctgtgctttaaaaattagcaaaagggagcacaaaatactatccaaatataaaattctatctctcttgtatattacagcaggttaagaaataaaaggcaagaaattataagagaaattagagaactaaagacaggcaggaagaagaagaaaaaaggatcagagatatagatggaaaagagttagacaataaaatacagggatcaagatggagaaaggcatacagagagaatcagaaaatgtatgtcatctacttctgcacaacaaatcatgccaaaatgtagtggtacagatcaactgcaatcatttattttactcatgaatttgcagtttgggaagggctcagcaaggacaactcatctctcctctattcactgttgcttgggaaagttcaaagtatgatgatgactcagtagctgggggctggaatcatctgaagtcttgctcactcacatgtctggttgttgatgctggctatcagctggaacccttacacatgacctctccacgtgagctgggattcttcacagcattgtgactggctcccaagagcacatgccccaagaaggccagatgggcatatcacctttaataacgtagcttaaaaagtcatataatatcacttttaccatagtaacaagtccattaagatttgaaaaaagggaccataaacctcatctctccgtggaagaaacgcaaacattacattgtagataagtgtgcaggatgggagatattttttggtcatcttagaaaattcaatctgccacagagcatatgagggacacacccacaaaatgactcatagaaatacatagaaacctttgtaaagactcaaacacaaccatttacatataactgacataaaaagatgtgaagaaacacacaccaagagaaaagtaagaggaacacaccaagtaagatgaatacctaaagaggcccagccttgcctagatcactgtcatcaactttgggctttttactccattgttaccaaagattttcaaaacacttttaccttttttctaactgtagacacaaatgtacctctctccactaggtgtttttactaaaggataatggactccagtcaagccaaggattgaatgcaacccataagctcgttgttattctctgcataaatatgttaaaaacaacatttgaaggaacaataaatagttgtgcaatgaatacagaaaataaagtaagttaacccaggggtttttttttttttaattccacagcccatgaactctctaatacaccaggttgcctattatagaatcaaaggaatgtcgttccctagaatatagcccctggaaaagtaagtgtaaaataaagtctttcagggtgacattatgctccagtcagaattaactttctgttacccaaacacaccacactctgttagtatgatgtgatgggctgaattttccaaagatggctacaacatcttccatcctacacattcttctgatatatgaccttgccactaccccattgagggatggaatctaattcccaccttgaatatgggctgtctttagtgactttcttccaataatagaagtagatgaagtaatgctatgtgacttccaagggtagatcagaggaagccttgcagtttcttccttaaatttgtgaaatgatcactcactgaatgctctttcttgggatgctctctcttggatgttctctcttggaaccccagtcacttttctctgggaagtacaagccacatgaagaagccatttgtaagatctctattcaacagtcctgctgagcccagccattgagtcatcacagatatgtaaggcaagaatctaccagatgattccagccaccagttcttaagccagttgagtctttcctgatgaaaacccagacattttagaaaaatataacattctccctataatgccctgccccaattcctgacccatagaatccataactgtaaatagaagagtgttgttttgtaccacggaatattggggaggtgaggtttgttatatggtaatagataatcaaaacatgtacttagcaaatactcttcccccttccctgcctagctgcctcctattcatattttatgtcttattttacccactatttcatccagctccaatacaagtaaaaaccaatgggcttgcaatgctaatacaattttaaaataagtctctacccattctcttctgatcagatgaccctctctttagcaactctggagccactgctgttcctacacctacccataaggaaaatcgagggtttaataactatgattaacatgaaaggactccaatggaaaaagtagaccacattcaagaacacttgagtaatataaacagagatggacattctaagaaaaaatttaaaaatactagaaatcaaaaacactgtaatataaataaataatgcctttgatgggctcatcagtagactggacacagccaagaaaaaaatcagtgagtttgatgatatgtcaatagaaacttctaaaactgaaatgcaagcagaaaaaagactgaaaaaatagagcataatatcaagaactatggaacaattacgttacactttggatataatagcattctttctcacccattatccatatttgtcaagaagttaattacagatgactaatctaatgcttatatgtatattcatccatgtaggaggaggcctacattatgaatcacatatacacacagaaatctgaaatgttgacaaaaatctcaatattttgagtaatagaagttgtatttatagtgtatatacttccatgagaaagaaaatctttctaaggatatttttgtgatgtataattacagtttttttcagctatccctaaactggtgcaactttagcagcatgaatttgagattcatgctcaaagaattctcaatagattctcaatagataacactaccttcatatattcgtatttaagagtaccagaggagtgtctacagccacattgtccaataaaaatataatgtgaccacatatataattttagattttctagtagcttcgattaacaatgtaaaaagaaacagatgaaattaaatgtgatactatgttttatttaacccaatgtattcaaaatattatccatgcaacatataatcaatatttaaacttattaatgagatattttatattctttcttccacacttagtctttgaaatcccgtgtgtcatgtgctcaatccctccatgtggctagggctaccatatcaggcagcatagttttagagcctgaaatctaaaggtgtaagcaccattcacaatcaccagaataacctgggaacttattaaaatacagaatcttgggtctcgtctagacctactgaatcagaatcttcattttaacaggattccccccagataattcatgcacattaaagtttaagaggcactggtttaatatgatgggcctttaggagaaatgggagaattgtggaagaaagagagggagaacagtgcaaattttgatgtgctttaacaagcttccaagtgatgctgatgctgctggacttttggtcacactttgaatggcacggtcctaggagatgtagtccagaagtgctcaccgagtaccttttattttctcagcactacggacagataaaagtgagctggatttcaatctagcaccagaacaacttagatcttctttgaaagacaggatcactgcagatgaaaacaccagaaagcaatataaggcagtattactaacatagcaaaatatttgaatcagacagggagtgctataagctgtcagggatatgaaaaatctgaggatgaatcagtgttatcagagaaggtagtttctctggttacgagagaggaatctaagctaggctatgaaagagatgccctaatgaaaatgtgagagtgggattggagagtttgggctctgcttactctgtgcagtgatccctggctatcctttgcttactttaagcaagtgatctccaaacttgattgtgcacacctatcagtaaaaatatcgacatatccccagatgacgtagatttatttacaaattgtctacacatactatgccaattcataaatattaataaagattaattatcttttagattaaaactaaatatgcatacatattgcagtatcatcttgctctctaatagatttggaagccactgctctaagtcagcatttttatcttcaggaagacatcatagtattctcccagcagcatgcagcacagtgtgattcaataaacagaggcaccaagtagtaaaaacaaatatatgctaggagactcagttgtcacaacttgaccttgcagtggtagatctcaccaatagaaagagtttagccattcacgagagggtagctgtgacagagttgagcaagcctcagcacagctttgacaagcactctttccctggcaaatttttcaattttccttcaggtttcagtttaaatattcctgaaagaggccttcccagaccttgcaatctgacttatgacctcttgttgatcccactcatcacatcatgctcttttcctacataaagctcatcacaatttgtaattcttagtatatttgggggaccatgcctttaacagctgtctccctactggactgtactccctgtgagaatagtagtttgttaacactgtgtattcagcaatgagacctcaatgtaacacacagtaggtactaaacattttgtagaatgaatggacaaaggaaattaaatatcgccatcatagtccttttagttcatacattactacctttttctatcatgtaatgatatgctgcatgaactaacacttccttctctaagtgagtcagagagaattaactggaccttaaacactagagctcaagtggtgactaatacggactgctatatagattggagggaaaataggacacacagtgcgagggctgttcaaatttttgtcgtcattttagttcctaatcttgattctccctttataaatgcctttttcttttctttcttttctttctttcttgctctttctttctttctttctttctttttctttctttcttttctttctttcctttctttctttctccttccctccctccctccctcccttctttccttctttctttctatatatatatattttttttgggggggggcacgggtgacaggtggtgtttggtctcatgaataagttctttagtggtgatttctgagattttggtgcacccatcacctgagcagtgtacactgtacccaacgtgtagtcttttatctctcactctcctcccacactttcccacacatcctcaaatttcattgtatcattctatgcctttgcatcctcatagcttagctcccacttgagtgagaacataacgatgtttggttttgcattcctgagtgacttcacttagaatgatagtctccaattccattcacgttgctgcaaatgccattattttcttccttcttatagctgagtagtgtcccatggtatatatacataccacaatttctttatccactcattgattgataggcatttgggctggttccatatttttgcaattgcaaattgtgctgttataaacatgcatgtgcaagtatcttttttgtataatgacttcttttcctctgggtagatacccagtagtgggattgctggatcaaatggtagatctacttttagttctttaaggaatctccacacggttttccacagtggttgtactagtttacattcccaccaccggtgtaaaagtgtttccttttcactatatccctgccaacgtctatcactttttgatttttttgattatggccattcttgtgggagtaaggtggtatcatattgtggttttgatttgcatttccctgatcattagttgtgttgaacatttttttcatatgtttgttggccatttgtatatcttgttttgagatttgtctgttcatgtccttagcccaccttttgatgggattggttttttcttgctgatttgtttgagttccttgtagagtctagatattagtcctttgttggagatatagattgagaagattttctccgactctgtgggttgtttactctgttgattttttgtttgtttgagacagagtcttgctctgtcgcccaggctggactgcaatggtgcaatcttggctcactgccccctctacctccgtggttcaagcgattctcctgcctcagcttcccgagtagctgggattacaggtgcccaccatcatgcctggctaatttttgtatttttagtagagaggggtttttgccatgttggccaggctggtctcaaactcctgacttgaggtgatccgcctgcctttgcctcccaaagtgctgggattacaggtgtgagccactgtgcccagcctgctgattgtttcttttgctgcacagaagcttttgagtttaattaagtctcatctatttatctttgtttttgttgcatttgcttttgggttcttggtcacgaagtctttgcctaagccaatgtctagaagggttttcccaatgttatcttctagaatcttaatggtttcaggtctcagatttaagtctttgacccatcttgagttgatttttatataaggtgagagatgaggatccagtttcattcttctacatgtgtcttgccaattatcccagcaccatgtgttgaatagagcgtcctttacccactttatgtttttgtttgctttgtggaagaacagttgtctgtaggtatttgggtttatttctgggttgtctattctgtcccattggtctatgtgcctatttttctcatatgccatgcagatatatattgttcaggcctattatgcacattaggcttaatggggaaatgtcagtgactgtcaaaatgacaacttcctgctgatgttaaaggaatctgatcaagcaacagatggtcagcagcagcagatttgctctctactttctctgggtttttattctgttgtttataaaattgttggtcataggttgttggattcagtgaaagcagcccatatgagctgagatatctatttcatttactatgtccgtacaagaagaaaacatgtcccaaccttaaatattgattatgcctgacatgcaaaacatgccaatgtcccagatccccagttaccattagactgaacattttgttatatccttttgcattcacatatgtatggacttgcctgtgatgtcatcattaaagcactttcatattctacaatagtcaggttgcttttctgcgttgacgttaggaagcattatctaattttagctgagtgcaagtctgtatcatgctattgtgtgagtgtgttttaaatgcactttgtatagccacattttgatgggtaagtttcacaaatatgcaattgatccttgtatagctgcctttaatcggtttcagtattttcttcaatagattctatgcatgtatcattttgtcatttctcagttgagggaatgctcagaacttgccagaagcagcaaaaattcacatttatagaataccttttcactgtattgagatgcttcatctttcataatctttctggaagacatttctgaggaatttctccgaagacagatgcattggtttctgtgactgatgacagtctgacttcacaagtggccttcttgagaggttactaagacttgacacattaacatcccataaatctcccatgttccaagtcttaaacatacatttcctttcccctagccacagcacagagaaatgcttgtgctcctttgacagtcatgcctaagaaaggaaaacagggagccacttttgcacagacataaacctgctcaatgtctcagatattttatgtacctaccccacttctctcttgaagtctccaagaaaacacacatgacctttgatagttcagaaaaatcttgtaaacctctctgtgatgtttaataatttcactcttcttacgggaatgatgcaccagccggtacagacagcttgtggaactcggctcatgggtaaaatgttcagtctcacgctgttttaacaacattggctctatcatcagtgcaaatagaaacggtggaaagaatctgaggagtgaggtatttatttggaatttcagctgagattatgtttttctaggcactgcagtgaaggtgcactttccgagagacgaagaactagcagagtgccacagagtcccccgtgagggcttactcaatatttgctggtaataattatgatgtcattccctgaggcaggcgtcagttaacaaactctttgaatctaaatcagccctgatttaatttgcccttcagtaaaggttaaaacagagagaaattcaaagtatacatcttgtagaagaaatagactgcagtttttaaatgttcaatttttccactctttctttccaattatgagtgtctcctctcaccctaagcaaaaaaagtcagtataattatgcccaaataagaagattaagtctagaaagtaacacaattttccttatcctcacaaaatgtgtcttgtattgtgtgcatgtgtttttaatttgcataattgctattttcttggtctttttttttttttttttttttttgagacagagtctcgctttgtcacctaggctggagtgcagtggtgcaaacatggttcactgcagccttaacatctctttttattatatattttattcagtttatttctttttatccttagcactggggaatatttcttgcattgggctcaccaactcataacatgtttacaatgggcccctgtttctaatgagttatttgtcccttttttcttccttccttttttttctttctttctttttttttttttttcccccagatggaatcttaccctgtcgtgcccaggctgaagtgcagtggtgcaattttggctcactgcaacctctgcctcccgggctcaagtgattctcatgcctcaacctcctgagtagttgggagtacaggcatgtgccaccatgcctggctaatttttgtattttaagtagaggtggggtttcaccatgttgcccaggctggtctcgaactcctggcctcaagtgatccacctgcctcagcctcccaaagtgctgggattacaggcgtgagccaccacacccggcctcttccttcgttttgtattgattgttgactcactaggaaagacttctcatatcttttagggtgagacttacgattgtctgttctagtagttctcaattctggctgtacaacagaatctctcgatgcttttgaaaaagcatcatacccagaccgtatcccaaaccaatgaaatcatgacatggaagcaatgggacctagtggcagtacctttagagttcctcaagtgacgccactgtgtagctgagggtaagaactgctagtctacacaaatgattcaaacgattactaggtagttctgagttttaaaaagttaaaaatcccacaaatgtttaattaaaaaaattaaaagtcccacaaagccattagacaatggacaattgtctggaaagatttcataaagccaaaccctgtgaggatttaaagaaataggacagacacggtaatgtggcaggtttagcaattactgcattctctgagtaactatccgaggcagtatgtcatagacctgctggcttctgacgcagtctctgcacctcatactagctgtaagactttgggcattttatttatcatctcagtgtatctatttcctcttctgtaaactggtgttgatattaccaaagcctatgtcatttcatgaagattaagggtcagaaaatattttctgaaaagggcttataattttggctttataggtcatacagtctctctgcaactactcagctctgccattgcagcacgaaggcagccatagacattaggtaaatgaacggatgtggctgtgttccaataaaactttatttacataaacaggtagtagcccaaatttggcccacaggatataatttgccaatgcctgtactaatacatgcctcgtggctggcacagtgggttgctatatttgttgtcattgttatgaagcctaaaaagtagcccatctccctaagatgtgtgcatttacccttctctctcagctccacccttggcctctttcaaacggaccagcctccagcacgtagcacaaagctacaatagctgcaggtcttaggacaggagaaaacatcaggtttcccccgttcatgaatgtgctctccccttccagtcaacacagtcacggagcaaggagaaaagaaaaccggggccagagtgcagggccagaagtacacatctcccagtggtgcatcactttataggagcaaacaccacagacactaaagccatcagggaaaactgtgaattaaaccatgagtggtaaggagctgccaaaatcccagagatgtaataaatcattactgtcaactgctcagcacgagtaataaaaaatcaatccactaagctagaaatgaatttgaaaattgtgatttaaacaatagtaatgtgtgagcaaaataaacagagaagcagttgtgctatttcatctttcaaataaggacagaggagagtgataccaggggtttgttttcttttacatcaacggagcagtaatcagtgaggaatggctgtgtgagtcagcagttagaaacaaaactgaatgtgatggtgtactctttcctgaggatattaaacccattatttttgttttgcaggtcacatttcaaaggccagatctttcccagggcttaagctgttccttggatacttttggtaagtcatttatccactaatcatttagtaatcgtctctgacatgccaaacaccctgctcagggctggaaatgcagaacctgggaagccactggccttgtcctcaagatctctctctggctccctttgaatttgctaattcagactttcacatttcccccaggaaaaatcataaggaccaaatcatatccgttttctcaaatggcttcaaagacccatgtcatcgtttggcatcatgtaattctttactgatgtactttaagagtcacgttttattctctttatgcagctgtcaaggacagacacaaagagtgggggtgtcttcctcactaaatactttcccacaac

SEQ ID NO: 4425 - DNA, 674804 bp, human; identical to SEQ ID NO: 4424

SEQ ID NO: 4426 - DNA, 1009 bp, human
tgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagccctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagacaaaaagcccttttgaacagcacataaagaacaataaggatacaaacaaatatgaaggatggcctgaagttgtagaaatggaaggatgcatcccccagaagcaagac

SEQ ID NO: 4427 - DNA, 2787 bp, human
cacaaagcaaaaccaagagtatttattttcattattttaaaaaactgcaacgtttatttcacaatccctggaactgtaaaataactattcttttaatttacagaattgagggaagtattttaaatgtcaaaatacacatgctgaatgtgatttagcatataagcaccaaaaatcccaaaagtatacaaagattgtttaaacatataaggtgcatttattcatgaattaattacattcagtttgaaggaagaaacagtactccaaagttcatcaatatttaagaaattatccgaatagcttccaacttggtttacagctaaataacagatactgcttttaggtttttttatacaatgcatctaaaccttaggttcgaaatttaagtgctgccttacactgtgaatggcagtttgatcactaaatttatgttccagtttgagatacttcatacacaacatatatttaatgccctgaaaacttctgcttaaaaactgagttatttagtgaacatctgaaggtaacaaaaaaagatagatcttgtatatttttatgtagaattgggtataaagtcatttggggtcaaacacaattattttttaaatattatcagtccacccagtaataagaacttttgtaaatatgccactatagcttcgggcaataattgctattatgaagttagataaacacaggattaatttcttggtttacaaatcaaaattattgtgatattaaagcatgcctccttccaaaccacttggtcaatgctgataacaactaagaaaaacgtatgctagtattgctctaaatatactgacttagctgtcctgaatgacctaattaggttggggaggggacttggcctggttctccagttctgtgaagctgccacctccagcctcactctaaatagcttatacaaaatcaagttattcccatagctaacacaaatccagcaagctgtggtcctaaatgccatctacatttatatatttacttttttactgtgtacattaagaattttgttgtgcttttcacatatccgatgtatgttttcatattaaacattcctcagtttcttgggaaggaaagaaaaagatcatgaaaagaggtacatcaggagagtcggactgtaaagtaacattacacacacaactagccaaatctctttttaatttaaaagataatgtcatcacaaggcaacatatagaaatataaaagaaaataaagtatccaccctaaaatccctattattccatgatattttcacagcaactagtatatatatcaatatatttttcacaaaccattcagttacacattgtgtatgcttttagaatttaaaatatgtattaccatagcagtctaaacattgtacttttagggaaatgtgcggagacatggttcagtgatttgatcattgtgatgattatttacaatgctatctatttacgttagcaataaataatcctgatatcaaaagagacaatactcatgcacacaccaagatggctgcatgctcttaaaatatttacacatagctctgccttttatagctctcccattaagagtgaaagtgcgctttcttcaattctctccacatttccattagtcttgcttctgggggatgcatccttccatttctacaacttcaggccatccttcatatttgtttgtatccttattgttctttatgtgctgttcaaaagggctttttgtcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagggctttttgtcttaatgcccttcccaccacagaagacccagttgtctctaaaaccaagattagtaatagatgtgctccccaaatcagcaatgagccgccgtgcctcatcattgagtttggttgctccatcatcgtatgttcccattaaaactattgttccatcttgtatggccttcagaaactcaataaatggtgccacatctcctccccacatgtcaaaatatttagtgtctaatacttctcctgtttttccatttgccaaggcaacattgatccctcttccaacattattcttaacaccactcattaaaacattatcttccaggcagattttgggtcccaccacgttggctgctccacttgccattttaaaagcaaaatgcttctcagggcaagcttttgagatcccacacttatatctgggaggctttgtagaacgtgcagctgtgtccaatgctgatcttgcaaatagatttcctaaacttgcatccatttttatttcaaatacttgagaaataacataaaatgtcagtaaaaacactgccacagctaccaccaactttgcagcacctgctaccctcatgtttggtttttcagtttatggcacttttcattaatatgctccggcctcccgcccgcctctccgccgtgcgcgcccgccttccggcttcccagcgctcagtcctgccggaggccgacgggagccgccgcctccagctcgcgcctccgcttcctctcggactcccccg

SEQ ID NO: 4428 - DNA, 70356 bp, human
ttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtgagaggggacgggtgcgggcagactccgccagcgccgcggccgcggtcgggctggctctgcgctggggtcccggctgagagcgccacctctcctagcccaggcagctgccgcagggactctcctgcaccgcgcgccccagggcggccgactggagcctcccagcctcctggacaaggagcgtcggggtccgggtccggccctgcccgcgtcgcctctaccgccaccccgcagctgctgcaacagttggggcggcggcggccacagtgctgtggtcggtgcgcttgttttggtcgcagtgggcttgggggtggggaggctttggggtaactgggccagcaaggagcagaacgagagaagacattctggaaagtcctactacttgagaacaaaatactatgcttggaggggattccgagatacccctccctgtcctcagttttgtttctccctttttctggccccccggagtgtttggggaacggttgttggtgtgggatgttgggaaaggacaaaagaatgtgaggcgggatggtgatgaagatgcctcccacccacccagaaagaagtgtggtctctggcgaggacagggggctgccctgctgctctcttctccggagcgaggtagccatctctatcttctagggtatgaaattatgtttgtaattcgcagttccttcgtctttcacagtagctcctcaagaaatgccaaaactttgggaaaagagggaaccgatcaatccacttttatttgggtgcatctgagcatgggggtgaggggcagagcccgaagggtgagaacagaagccaggctgtgtgaccccgagaagagcacaggaaaccgagcagctggttagagggtgacactcgcagaaaccggttgtgccatcagcttgaggtgggaatttgatgtggaaagtgaggttaatggtggtaactttcaggaacttcctaagaaaagcagaggagtgaggactagagatggaaaagtggagacctcgggagagaaaagtaaaaataggtgagaatgttccatctgaatccctgatggggactgtggggcttgtttacttaaggttctcctttggggagggcagacaagaaccagtcccagctgggactctggtgcagagggatggaaggtgatcgttttgtgtgagtctctagtccagatctggtactagaggctggttagatttctagtctacttatcccaaggggagtctgccgggaaacctggggaactctttcctcttcttttcctctacaggtaatagtttatccctagagacaagctaattttcattattttcctatgtccgtttgttgacatgttatcaattagcaattagtaatgaggggaatctgactaggggctcaatggaattaggatcttcccacatggagtggctcatgatatttttaatggcacacatcacacatttactcatcacagaaccttaataacattaatcccgagatgtttgtttttctcatgattagacttccagcatcaaagtggttttcttttttctctcaatactttagtgactatattttgggacacagataaatactgctccaaaagctttcccacgaaaacacatagtagattcatcatgggcataaggaaactgtaatttaaccagttctgacagttggaaatgccccgtcttttgattgatgatctactaaatgatatttctctttttgtgttttttcaaggtgacgtttccattgcctttccccccccacccacaaaccatcacaccactgtgacaggcagtcaccagttacagtcactctcaaggttaatgagacatcaacaagcattatcagatctcttttcaactggattacttcttccctatttgattttgatcagttcaggacagaaaacagtgctataggagaaggttgagactggagagacggaggcttggtttgcctccatatctaaagggcaactttaaaggacaatggtcaaaaatcagtggattgttttaagaactgggatggtttttcatcttctaggtgtctgagtaaaatcaaaaccaagcctagcagtggtccgaacttatttctagctgatgactctctggtcaaatgagttcatacagcttataaaaatccagacttacggaaccaaggaaataactgtcttcaattttaaattatatgtttaattttttctttctgcatccagcccctacttttggtagatatggagccaggggacaggaagatggaccttcattagtcatggtaatgtaaagtgtgggagtgagcacttttttttttttaatttttttcatttagagacatgatgacttgtcctttaggaaaggtgtcaggagtgaaagaatcactgttattgttgttactagtgttattctgatgcttcgttactggcatcaaggatagcattgacagttaacactacacaacacccaacagtccctgccccctgccggttttatggcgtcacatttgaaatgaagtgaagtggacagagcatgagcaggtctgaggctttttcataccccagtacagaactgaggaggtgacttgtagggctgtgtagggtgttgcttcaagcatgaagagtagacccattctctcctcttaatgttttgggattgtacctgtgcagtgaaggagatccttcttgggatattggtcccactatttgctgacaaaaaaaaaatagactgggagggagtgatgacagaaaacgaaaagccaggttgacgtttttaaatgtaattgagagtattacagaaaaatatctgtatttcaaaaatccagctgatctggtttggaggagctttctcgaatatgcgcaagtgatatgattaccatactctgaccactgtagcttagaagttgaccccacactgtgaggcatgactccccccagcgttggtttcccctgaaggctacagggcaacgatgcattattaggcaaaagtgggtaggacctggtggtgctgataagggctcatgcagtaatttctgaacctctttacatacatgctgctcttcaaacatcttccttttcctagaaaattaaatttagctgattatatcttttaacagaagatccatgatgttcatctcaaagcaaatttcaaaggagggcctcacaagcttttatagatacgtttcgttgcgatcacctaaaatgaagtgtaagtaggtccctttgataattgatccaggctgttaacaaaacaattcttgatttattccggaatcatctatttaaagtgaagaatcagtacagcccagtacttatgataatgacatcatctttataggactttataggttagaaatatacagtatgtttaaatacagtaaattgggaaaaatgctatatcccattttacatatgagaaaactacttcttagaagttaactgacttgtccatgggaaaaaatacaaggctagaaccaggactggactggacccagggttttggactccaagcccagtgtgcttttcattgtaatttactttcatatgatacactactggaatgatttaaaatgtacatttttgttatccaaatgaagtacagttgaccaaagttttatatcccatcccatccagttgttctaatagtggtaattggatcataagaatatttttcttgactgattctgtctagtgtcaattaaaatccacatacagaaactccaaatacccaaagtaaagcataagatatttataattaacaatatacaaggatagaaagaagatttttttggaaaaaaaatctctggatgattgaatgtagctgcttcctgattgagtgctgctcattggcagggtccaggttgactgaactttagtgccttacacactccctggcacataatagctactcaataaatacttgttgaatagaccctccctagtttactcagacatttatgtgatgagttaaagaaaattccataaaaacgaatttgaaatgtatttacatagtgaaatttttatttttacaactttacagacagttactaggattctttgtttgcaagatatcattcttccctccttgataacccccgtagtcatatcaaagcgtatttcagtttcaaaattgggtaggggaattgcctttgtacaaagtcctcttcttcaggggaaactcagaatgttttattccaaaccacgggaaggacgcatcctcacatagcaaacattcttccatttactaggagatctcatttcgctcaaatatcaagtttctgttttacttaaagcttttatgtttaaatacattaaatagaattaagttgcaaacaaggttaataaaatctaaccttaagttatttacttcaggctttccaagaagggcagcataactgctagctcggggtcacaaagactgggtagctagatcaagatcatagtttttccaaatgctgtctcaacacttgcaatcactatgggaatcaccatcatttcttcctccacaatctaaggatcagcaaatttcagcctagtttttaacgtagactgagtttttacagttttaaaagattataaacacaacaaaacaaaaaccaagaaagctatatagcagaaattgtggctcgcgaagcccgagagatttgctatctgtacattcaaagttcctatgttgtattctaaaatgtcattactagagcactttcaagaagttaatactgtgaatctgtaaggcagtagttctcaaccggggctgactgtgcacccacccaggggacatctggcaatggctggagacatttttggttgtcacaacttggggaagaggcatgtgctactggcatctagtgggtagaggcacagcgtagcccccacaacaacaaaattacccagccccaaatgttaatagtgccaaggtggagaaactctctgctttgcatgtttcttttgttttataaagattctttttttgctactttgattatgtaaaatgaaaaaatgccaaagagaagttcatagaactctggggacaactattatgacctctgaggtgatgctctcttgggcagttgagcagagaccagattttccagtgtaatcgtccccaaaatgcagttatcttgctctcttcgatggctctgtcccttcaggtctaaatcccacctgctgtagaggagcccaagaaactgaatgcagtataactgcttgaatgacgaaggggctaagttgacactggcctttgagacttgtccattactagagtgcccattattggcatgccttaagcatcagtcagcagcagtcgcccacttaggtcgggcttcttctgacagtgtgtaagaccccactgtgagcagcgacctgaggaggcaggaggcagtgctttgttgcctattccagtctctctgcttttccaagtataaaatgacaagagaagagcttgtatcaaagaaacacggaatcaaagaaccttcggtttagaaggcaccttaaaggtcatctccacagaggctgatgctagaatcttctcttagcatctcagggtgctttgtttggtgacaggtgctatgaagccttgggcagtccagtctcttctggtgagttatccaagtggcagatactcttagaaaagattgagcctgggcctgaaagggcagcatttgtgtatttgctgggtcagtcaattgacttttactctttatttttgtactaggggaaaattaaggagagactgagatcggttttcattctcctttcatttcgtaggtagtgtatccgaataatctaagcacagtctcatcctagggttgtctgacttttaagtacatttgatttttgcgattagtatgtaaaatgcccacttgtctcatttagatttggggagcagtcttttaattctccatttaggtacacatttgagacaaactttgattaaactgaaatttagatataaagccttagtgggagaggaagcccacctttgtaatgactcatggcatcttgatagatgccatattagagttaggaaaggatgattctattttaaatgaccacaaaaactgagcctctcaggattcaccagacctataaagctcacaggacagtcaagcattgaactgatgactccttaaaaatacgagaaggagaagtaagctaacagaagttatttgttttctacctgagtgtttccagtcccttggcacaaaagccagggaaatgtgagatgctggtgagctgatcaactttgactttgtgggatgtgccatctggtacctgatttcggggctcagtgtgagccccaagtgatacttgagataggcttaaagcagacctttgaagtcacctgcttgatagcacatcacagcaagcaggcctgtctgcagcactgcctgtgtctccgccacatacccggaaggccacagaactaccgaggaatcctgccagactgatttaatgaccagcaggggaggtgagtaatcgctaacctttaaaagacaagaaaaggaaaaaaagaaaatcaacaccagttgttatttcttacgggaagccctgaataatatgttgtgcttgcaacttctgaattcatattttgaacaaaaggaggcagtgaggaactagaaaaagctatttttatcttcttgctctctaagaaatcctcttgagaatattgtttctgctattttgaaagatccccattgttaggtcttccactttaggtttaattcataggcttcaagtacagttaagatgatttatgtaagtgcagtcggttatcttgggaggtgatatcagaaaaggctgataggggagtggggaagtaaaacagtgagtagcaggaagccaatcaagagagtattattaagcaagtgtctactgtgggcaactggggctcagtctcactagggaactctgggagacactgtagaatgtgttggagaaatctcagttgtggataaagaagctgaatattttctccccaactccagccatcatcggctgattcaactacatttagaagcattaaatttctggcattttcatatgctgtgtttctccctatatatatatatatatatatatatatatatatatatatatatattttttttttttttttttttttaaaagaattgggtacagagctacaggtgtttgtggcaagcaaccttagcatggagaggtgagtgtgagctgagactatatgggtgggaccctgagagcatctgccctaagggtcttatattcatctagagttatacatcgagagatttagtgccccgtttctagggaatggatattcatccctttactcaacaagatggctatgaccctgtctccatgaagcttacagttaagaatcatccagcatagctatttagttattcccaagtttgacaagtgccagtggatgctggtaaagatgactccaaacagggcctagacaccaacaggatgtgtggttttagatgccagacctctacatttgagaggcacatattcattctcacctttatgaatacagaagtctgcaggcccccatcttcacacatctacttttgttgttctccctaaaagtgccctccctcctctctttaaggaccagttcacatgccttctactttatgaggctttctcagattcatggcttcttctctcccttaaatctattgggctttcattcttatacacattctttaatgcagagctgtagactcttatgtaatttgctatattgtcatgtgatcgtttctcttaagagaggtaatgaactcttcaggggcaggaacaatgtctgacactgccagatctctcctagagcctagcataatgtggagtttgcagcaggtgcttaataaattgttactggtttatagcttgtaagatggaaaatgtgctctgcctccctattgatttattttggtcaaatataattttgcctggtagcatgaccatgtgatttcttgtgctctatattcatttttcatctttgacaaatcttggtttcaaacttgttgataagcaataagcatccattctgtttccagatctgctgccatttatatgaggagaaattcttggaaaaccaaatatctgacaaccttctctggtccaagtacagtttgggagggtatgaacttgacctcagtccccaatcagtggtgcatttccatgtgggagggtggatccctgtgcagttcccagtgagcaccctggaacccaagtccccacactacacattcccttatttacttaaagaaaagtctcaaaacattggccacacccatattcaaatgtaaataggaaacacacttaaaagaaaacatcaaggacaagtggttttcctgaccatagcaccagtgttcaggagatcaccattctgatgttgcttagtcccactcttcttaaaagttagcccagaggaacagaaagtattgttctaagaggcaaacttaaaagaaaatgatactggtacaaaatcagcatatttctgtgagtttaatggaaacactaaaactgctaatttttcagcgtggaagataaagattcctttacccattcctccatgaggctctcctgctgtcactaataccatggctttgtcaattctttctaattgtctcaagaaaaaataatgcatctctgctatagagctgtcattataaatgctcaagaacattttgtgatatttataccttaattgtatgaggtttgagttgttggattttgtttttggtcttgtggtataggcaagtagtcctactgagtaaagattgtttgattgctctcagactttctaacatgcacacacgtcacctaggcatcttgctaaaatacagactgattcaaagggtctggggtgggaactgcaagtctgcatttctaacaagatctgaggtgatgctgatgctacagatcagcagaacacacttggagtagcaaggctcaaatttaactgttgtaaacagaaaactggatttagaatcaggaaagccaagttcaagttccagttctcctaagtatgtatctttgggcaagtcacctaacctccctgagaaacacgctccttatttgcactgggtgtaatagcatctctttcacccacttaaggtaaagatagaatgagataaagtatgtgaaggcactgtgtaaccatagccttctgtaaagtgtgttatcattattactatttactttgaaaatgactgctatttcctcacatgtgccagctctttcaaagccattattgcctgttgagtaatacacatgtagccacttttttctttgatccaacaggcaataatgggtgctcaagctacattcaatactcatattgccaatttgttggtctttaatgactccatctgagtcattacagacaattggattcaacctactgctgagcatgcagctcctctacctgcagaaagttcttaggcaggcagagctgcggatggggatgggtgcattgcattccagcacaccaacgtggttcctctgggctcagaacctactcttcatgcctgatggggctttgcacacaaaaaaagccttcacttcctgcccagggaagtgccttttgaattaaaggttctgagaggctgcgggctctggtttcagggctctcctcaccacatctcacagcacagcatgccaaagagggattctccagtgatttaggtgagaacgttgatcattctcctctcttactgaatttacatgactacagtgtttccctgggaaatctcgtccacataagtagatctgcaagcacttcacagggaagagtgtcatcagaattgccagagatcaggagcaccaggcaaagtgataattgtaaagtcctttgaaactggaatgttgcgaaattttgcagactgtgaattttgatcatttagttcagtgtgcttccccacctacccctttagaaaattgctttttataggatcccaaaagaaatccacaattattcaggctccacatcaaatccaccaaagaagattcctctgcctagctggttctctatccctaatctcttcaaacaaaattaacctctgtgtaagtgagggttagcagtacttctcaaactttgtacttctgaattccctgggaatttcagcatgcagattctgattcagtaggtctgaggcagtagccctgacattctgcacttccagcaagcccccagggatattgatgctactggtctgcagaccacattttgagtagagcagtagattagtggatctaaggaaccttgctgaacctttgtatatcctgactactcagttctatttaattgcctctgtaagctaaagtagtggctctccaacttgagcagataggcattggagaacttgttcgaaacagattgtggtctccaccccagagagtttctgagtcagtaggtctggggtggagcctgagaatttgcatttctgacaggttcgcaaggtgatgctgttcttgctggtctagggaccacactttcagagccactgctataaagtatcctagaaattagctaccaggactacttccaaaaatgcagtctctctctgtggaatctggccaataagatacaagcaggatgaaaaagttgtttgctcagcacttaattctgaatgatgctataatagctcttctacaaagggtattaaataaatctgaatatctgaagtttgcactgtaaggcaagcatgttgaacagagggccgtactctactgcctgtctcctggtgttggaattcaggagaaaagggctgagtagaagaaaggacaccctgagatggaggaagagagatacacctcccccacaatacacacacaccatggatgtcgttgctaccatcacatatgggattgccaaagctttcgttcttccaaagccttcccatacagggtcatctgccatttgccttttccagaacttcctttaaagcaaatcagatggtacagcaggcacaaataggagctacatgctgcatttctgagacagggtcccagtactgtggttctgttaaagaacaagttactcaaaacccttgttaaagaatggtaaggcagagtttattcagcaggagccactgagatggtatagggactactgcagtggggttttgcagtaggggagagatccgacccactcggaatatgacagggaagagtgggaatttatagccaaggagcaggatggggtcagtggatacaacattattaagaggaaacatcagggggaaggggcagattctagctaaaccaatccgacaggattcttgctgaaagctggccaggatgatcagatatcatctgagagatggtcagagatgaataatttagtcagatatctagaatgatcagatacaaagggtgggggattatggttaaatggatttagaagaagtcttcctaaaattggatgatgtaaagacagaaaaggaaatctgaatgccaagggttagttggtgagaaggttcagaggagcctgactagagtttggtaaaggagagtcgtcagttgtcagaggtgaggtgtccacagggaggaccctggcaactaatgttcagtgtcaattactgtttgatgtcaagtgctgtcagagagaggtgacagttgcaaccaaaattcagtgggtaccagtttaggcagagtggaaaaagcattgctttagaacccaaagttttgtgtttgaggctgtgaactattaatgtgtccttgatcaagtcagtcacttaacctctctgggaggtctcaatttcttcatctataaaatgggatcaacaatattatcattgtgaaatccacccagtgttctctattaacaaatgcttactctccaggagaatggacttgccagagcacgattctgaaactttatcctaggttctttcccatttcagcccccttcagcctttctgccttacctaagagttggtggggggagagtcaacaggggtcagggattcaaagaaatcaatttgaagcactacagccagggaagggaatagaagacaggaaaaaactataccactagagaaatacttgtgaaggtcacaggtctactaaaagactgagatttcattggaagattatatagcaatttccccttaccacactttactaccacatcagcagagctccagtttaataatagtggattacagctgaaagagcaaaaagacacagaccctctctgaggagaagtatgtgggaaaatccaacgtcaacaagagagacaaaaacaaggacagtagaggaaattaaagcttctggtacctatagctacaacaaacattaaatacattctgacccctagattaacataaatcttccctgtaaagtcctgttatcttagttcctattaactgatataacatgtctagccttgaagaaaaaattacaaggcaagccaaaataaaatatatatagtctgaagagacaaaggaaacatcaaaatcagactcggatatgggaatttaaattcaataccagacagggaattgaaagtaactatgaaggccaggcgaggtggctcatgcctataatcctggcactctgggaagccgaggtggaaggatagcttgaggccaggagttcataaccaccctgggcaacatagcaagaccccgtctctacaaaaaaatttaaaaaatattaacagggcatggtggtacatgcctgtagtcctagattcttgggaagctgagacaggagggtcatttgaccccaggagtttgaggctgcagtgagctttgatcacaccactacattccagcctgggtaacagagtgagatcctgtctcaaaaaaaataaagtaacaatgattaatatgttaagggctttagtggaaaaagtagacatcaagaccacatgggtaatgtaagcagagaagtggaaacttaggatgaatcaaaaggaaatgctagagataaacactggaacagaaatgaagaaaggctttgatgaactcatcagtagacttaactgccaaggaaagaatcagtgagcttgaatatagggcaatataaacatcacaaactgaaacacaaagagttaaaagagaaaaaaaaaaaaacccaaacggaacatctaaaaattgtgagacagggttatcaaaatatatgacatacacataattggaataccagaaggagaagaatgaagcagaagacgtttgaagtaacaatggccaaaaactttctaaaattaaagacaccaaaccacagatccaggtagctcaaagaacaccaagacagataagtactcataaaaccacacttaggtgtatcataatcaaactacagaaaaccaaagacaaagaggaaatcttgaaagaagccagggtcggggggacaccttatatatagaggaacaaggaaaagaattacattagagttgtcagagaaaaaactgcaagaagagaatgaagataaatagttaaagggttaaaatgaaaaaaaaatcaacctaaaatgcaatagccagcaaaattatgcttcaaagtgaaggagatataaagactttctcagacagaaactgaatgagttcatcgccagcagtgttgtcccgcaaaaagtgttataagaagttgtttaagaaaaaggaaaattatataggtcagaaactcagatctatataaagaagagtattagagaaggaataaatgaagctgaactaaaatatttttatttttcttactcttaattgatctgagacataacttcatttaaatcaataatagtaacaatatattggatgattataacatggataagtgaaatgaatggcagccatgtcacaaggcatgtgagggaggaattgtgaataccctgttataactgcaccacatataaagcagtattgtttaaaggtgaacttaaattaggtataaatgtgtattgtaagtgctagggaaaccactaaaaatttttttaaagaagtaaaattgatacactaacagaggagataaaatgctcaattaaaaccagagaaggcagaaaaagaggaggtaaaaaaaacaggaacaaatgcaaaaacaacaacaacaacaaaaacaaaaaacagaacagttaccaccatggtagatattaatctaattatatcaataatcactttaagtgtgaatggtataaatatacaaagtaaaagatgatgactgtcaaagtggattatggaaacaaaaaagacctaactctatattgtctataagaaacccactttaaatataaagagtcatacagttaaaagtaaagggatggggaaagatatgccctgctaattctgctaaccaagagaaagctagagtagctatgttcatttcagacgaagctaacatcaaaacaggaacaattatcaggaataaagaggtgtattacctaattataaagggatcaattctccaagaagatacaacaatcctaaatatgtatgtacttaacaacagagcatcaaaatacataaggcaagaactgatagaactgaaaggagaaatagacaaatccactattatagttggagacttcaacattcctctgtcagtaatggattaaacaaaaacaggcagaaaataattaaggatatagataatcaggacagagtaagggacagcatgtctactactctgggaaaatacataatccgactctaataagggtacctcttacagaagtgtaggggttaaataggagaagcaaaacactggagatagggagatgccttctgtgcacccaaggagctgttaaagtctgcaggcagaaggcttggaatacaatagctgcagaaagagaagaaaggacatagatcagaccaccattttccaaaatgtgttctaggaaagctccctttagtgctgttaaaaaaaaaaaaaaaaaaaaaaaaaaaaagacctgtgtggccaaataactttggcaaacaatagatgtggtaccaccatctcagatcctcatactgcatgcacgttatcatagtaaaagctctaaaaagttcctctgtaaagaaacctatttaactctgtccagtttggcatttctcaaatctatttgagatgaatattttttacttttttggtggcccctatcaacatcccaagaatctaatgtgcctcagaacatacactgaaaatgccagcccaaagattgggagatagaattaataagacttcaagataattggatctgggagtcatcaaagggaaaagggtgacgttggcttagaagtttcccagctgggtgagtagaaagaggatgatgctgtgttaaccattacaggaaacaggtggaagaacaaatttggagaaaaggattcagctgttgtatatatgccagttgcaatactcccaaaccatttatttgcaaatcttcaggaggcagatggaaattaagatccggagtttgaagaagaggtaaagtgtgaatgtgaactggagattggtcagtgtaaaggtcacaagtcaaaccatggaggtggaattcattgcccgtgaagaatatattctgttatgacaagatcagaagtgccaaagacagtcttgagtaacatcaaatttacaaaataggcaaaggtagagaagtcagaagaacactgagaaaagctaggtcgaaagataggaggagaggaaagagttgagtcatgtaattcattatgggagaaagaaagggtttcagtcaaactacaaatatttactgagtaactttgtttgccaggcatatagtagaggatgcagcagtgaagaaaccatgctcaggccttaccagagcctactggattcccatgaaaatggaatccatattttcatgggaatccagtaggctctgtctacttttcctatcctgattcaaatgggatgccagtatgacaactcctatgatttgtcatgaatgggaaaccaagtgccatcttcaaaatttcaggtcttaaatctggaggaggaagccaacatccttttggagccatgaatactgtccaaactccatctgttgctcagattggaatttcggtggaatcactggacagtatggctcagcagactcctgtaggtaatgctgctctatcctcagttgactcattcactctgttcacacaaaagatgttggacaacttacacaattttgcttcatcatttgctgtctctcaggcccagatgacaccaagcctatatgaaatgttcattctgcaaaatatgtttctgaaatggtacgaaaactttcaaagatgactagcacagaaccctctcttttggaaaacataatttgaataaaatagtttttaatggattctgaaatttgtcatgttttgaagataactgactccatttaaaagtatgaagtcaaagaatcatgaaacctaggtttaaaaacttcttagtgactgaagcttaattaaaatctttattaaaaattaaaaacattgaaaatggaaaaaaaatgctaaaccatctcaggatatttttaggtactcccttgactttttattgttgacttaactgggtgccgctgctcagagttgaaggaaatgaagatttaaaaagtagccattgaatttatcttcttagaactcattgttgagttttggttcagcgctaggatagaatctagactgtagtggtttgagaagtgagtgggaggtgaggaaataaagttagcaagcacaaatcactctttgaggtatagttggagacatcaaatgcaaagggtttattaaagaaggggagatgtggcagaaggtggaaaggacatggggttaatgaagccttttttaaaatatggaagagacatgaaaatattttaaaacccatgggaaagaattagtagagtttgaggacgtgggagaagaaggaatgaactgtactagaaagaaggaaaggaaagataaaacccagtgaaagcaattgaccttaaaaagagagagagccatgggccttgattttcacaggagggcgagaaggggagtaggtttaggtatttatatggtggcagcaagttggtaattcccatctggctggggtttgctctggaagatagaaaacaaggtcagcagctgaaaatgagtcttgtcaagtgctaaagaaagaacattctaatatctgtgagcttggtgaccaactgacaagggaatgagaagaggctaggtcctaatgtggaagcaatctcttttacagaatttgagtatgaaagcaaagggacagtctctccttcccttttatctcaagatgagcaaaagtatagagaagaaatttaagtggaagtttgttgagagagttcacatagggtatatttaaatttcagaagaagaatatggattataaagtaagaaagaattattaactccgagaattatttggcatttgaatagctcatcagaggggactggaatgacctagaatggcttaaatagaggttgggatggtgtgacctccgaggatcacatagcctttaaatttcatcacatatctcagtggttctcaaccctggctacatattagaatcaccgtagtaactcaaatatactgtacccaagccttaaacccatggattctcatttcaatggtctaaaaacagtggcctactccaaatacagtccacagattggcagcgtcagtagcactggcaatcgcctgggaccctattagaactgcagactctcaggcttcacccagacctagtaaatcagaatctgcattttaacaagatccttagctgatttctacacatcttaaaagtctgggaagcgctagactaaagcatggtctaaagtggggcccaaacttaggtacttatttgaagctcccctaggaaactctaatgcacggttagagttaggaactgctgctagatagaaaaagagatcattttacaactgtattaagcgcatgtgataaaatctcattgtattctatatacacacaaaaaagaatgcatgtaaaaactggtgaaatccaaataaggcctgtcacactgaccaaagtcagttttgtggttttgctaatttactatggtaatgaaacatattaggggaagctgagtaagggatacatgggaactctaaactaatttgcgacttctcatgagtcttaaaggtttttttgaaaaaatttaagctaggccgggcacagtggctcatgcctgtaatcccagcgctttgggcggccgagacaggcgtatcacctgaggttgggagttcgagaccagcctgaccaacatggagaaaccccgtctctactaaagaaaatgcaaaattagccgggtgtggtggtgcatgcctataatcccagctacgcgggaggctgaggcaggagaatcgcttgaactcaggaggcggaggttgcggtgagcggagatcgcgccactgcactccagcctgggcaacaacagcaaaactctgtctcaaaacaaaacaaaacaaaacaaaaaaaaaaaacgtaagctaagagatcctacctaagatgaagagcagctgctttccatcatcatctgagatgaacacgggctccatcatttattcgtagcggagccattcaaggatttaaagcagaggaaagacagatttggatttgtgttttagaaaaataagtctggtggcatatgaagggtagatggaaagcaaaaaaagctaagttaggaagctgtttctgccatccacatagattataagggctagaaaccaaatcaggagcaatggaaatggagtagcagaggatggatttgagagatttgggaggcaaaatcaacaagattttatgaatgatggaagggttctcaatcttgactgtgtgttatagtcttctgggacgctttttaaaatacagatatctaaaccctcaccaagagattctgatttaatggtatgagggtgggcccaggtatctgagtttgtaaagttcctcaggtggttcaaatggtcagggcttacaggggctagatcagagattcaggccgaggaagcgggaagtacagagcaagcctcataggtttttaatcaagtattccaggaaccagcatggatgaggaggaggtagcaaagatacagcctggaaaaattagagcggtagcccttccttttccatttgttttatgttgagaaaaatcacaaaactttgagttaacgtgtgtaaagccataatccttgcaccttatctatcttcccatggcctgtctagacaaacagattaaaaaaaaaaaagttcagttgtttgtgccatctaaacataacctcagcttattttacacagagagagagagagagagagagaaacacacaactttcttgtcaatcccaaaatttgaagtacacaaatatatatatatatatatatatataaagaaatcctccagaagctaggctagaatggcttgggaacaaggtgaaattctttttttttttttttttgagacggagtctcgctctgtctcccaggctggagtgcagtggcgccatctcagctcactgcaacctccgcctcccaggttcaaactattctcctgcctcagcctcccgagtagctgcgactacaggcgcctgccaccacgcccagctgatttttgtatttttagtagagatggggtttcaccatcttggccaggatggtctcgatctcttgacctcgtgatcaccccgcctcggcctcccaaagtgctgggattataggggtgagccaccacacccggccaaaattcttatttttttttaactgctgctagccattctgtgtatttcggaaagcccctcccaagttgtctcctaaagtccacccagacattgttcccatctttctccagagaaatcgttcattttgtgtaggtttgcttttattcatgtaaggcttttttggggggaggggggagggagaagccagccaattgctgcgacaggtatggagtgtggttgctcctactccccgcctactggggcagcagggcagcaggcacagcaaagcttcctcagcactcagtgctaatagaccccgagattccacggaaggtgtcctgtgagtgcgcaccctaccctcagattcacacgttgaaagcagccaatgactgacagactgtcttttacagggtgatctgccaaagccaccagtctctgcctgataaaaacaatcagaggtttccctactgagagttgcttgccgcctattggggtctctctttataaaattgtgtgcaaagcaccatgaaaatgtttccacctcaaaatggtctgctctttggcatttcacttttcccttttaggacatttttgctccttttcaactgaaaaaagttacaaagctctcatagccattataataatgcataagcacctcataatataagcacatcacagattttaacaattattttaagtggttagtgtgagatagaaaacattaaggtggcatgtcagggctactgctatgttccaggttcttctattacattatgtctcagctttctatgagctatgttatttacaaggtaaaagaataacacctaagttcatccattgcttaagtgaacccaaacgtagtttgagatctgtaggccggtttaaattgagtctggtaaagctacttcagcctggaaaaggagagaagaaatgatagactgagaatttttaaatatttaaatattctcattccaatgtgctagccattttacaaatgcatatattaatatctgcctgtgtattcccttgagagctgggctggaaaagcgttgctatactttctggtttggttttgtttttaaactgccacagtatctttacttttacaaacataaaagtatatatacttattttaacaatgatcctttcccacatgttctgtttcctcttgtttgtttgcttttttgtttgcttgttttgctttttttctcgagtcagaattagctagtacttttgcttaatcacttctcagtatttaacaaggtttcaggacatgcaaggggaagctgtttaatgcacgctggtgatgccaaggagattgtacaagagtatgttggcttgtccagaatgtttctatcttgagtattgcgtgcctactctccacatgcactgtgctgggagcggggatataacaaataacaagattgagttcctttcttcaaagagctgaaagaagatgccattataatatttcaagtgataaaacagatgtgtaaacaccctggggaccagggaggatctaaaatgcgtgtctagagcaggcttcctggaggaggttacgcctaagctaagcccatcacttctcacaagtccaaactcctgcaagggagggcaggggactacaacttggctgctcactctgcagccctttcagaaacagccccagtttcttattagtgctgattcgcaccagctttttccccagaatagaggacagggctctaaagagtgcccggtaaatcccttccagcctcaaatcaaataagtcactgcagaatatcacatccagtaaaccttgccattgtacctccaacaaaaagagaagggctgcttctcaaaaagaataccaccctcacagcatgagagaggcagttgctctatgacaacgccactagacagcaaggacaaatatgggatttccaggcattaaattaaaaccatcacgcacttcacaaatagcaacttttgggtgaaggtgccagctacattttctgattgagatggggaaatgattctcaatgcacacaggagctgaagagtgctgaacacctgtgataggcttttctgccaggcatttcatctatgttgtctcattcgggagccaacaacactacaagatagtaatcccattttgatgctggggaagctaatgctccagaagggtgacttcctcaaggtcatcaggaagtgactaacttagtttgatatgaatacaagtctgtatgactgaagtgtcagactctttctaccataccaggctgcctctggggctcttctttcttgcagtgtttacagtttagcttactggtcttgaagttagatattctcccacagaacagtaaggaaaagacaaaacagcctaatatccaaggggcaaaaggcttgatcagatactttggaaaagaagatagccacagggctaatgagcatgtggaaaggtgcctagtttcagacatcatggaaatgtgaattaaaatcaaaatgagataccagtacacacccatcagaatggtaaaaaattaaaaagaccggcagtactgagtgttgctgaggatatggggtaactggaactcttatacattgctggtgagactgtaaaatgttatgatcactttgggaaacaaactaaatatatgcctactctgtgatcccaaaattccacccatgagtctatatacccagtgatgtgctggggctggctcctactgactcctgaaatctgactggccacatcttttccaaactcccactccattggtagaagaaaaatggccatggtggggtatttaccaacacaaaccacagcttttttattattattattgttatactgtaagttctagggtacatatgcacaacgtgcaggctagttacataggtatacacgtgacatgctgacttcacaacacccatcaacccgtcatttacattaggtatttctcccagtgccatccctcccctagcctcccaccccacgacaggccctggtgtgtgatgttcccaccctgtgtccaagtgttctcattatttaattcccacctatgagtgagaacatgcactgtttggttttctctccttgtgatagtttgctgagagtaatggtttccagcttcatccatgtccctacaaaggacatgaactcatcttttttgtggctccatagtattccatggtgtatatgtgccacattttcttaatccagtctatcattgatggacatttgggttggttccaagtctttgctgttgtgaatagtgccgcaataaacatacgggtgcatgtgtctttatagtagcatgatttataatcctttgggtatatacccaggaatgagatcgctggatcaaaaggtatttctacctctagatccctgaggaatcaccacactgacttccacaatgattgaactagtttacactcccaccaacagtgtaaaagtgttcctatttctccacatcctctccagcacctgttgttttctgactttttaatgattgccattctaactggtgtgagatggtatctcattgtggttttgatttgcatttgtctgatgaccagtgatgatgagcatttttccatgtgtctgttggcttcttttgagaggtgtctgttcaaatactttgcccactttttgatggggttgtttgtttttttcttgtaaatttgtttgagttcattgtagattctggatattagccctttgtcagatgggtaaattgcaaaaattttctcccattctataggttgcctgttcattctgatggtagtttcttttgctgtgcagaagctctttagtttaattagaccccatttgtctatgttggcttttgttgccattgcttttggtgtttaagtcatgaagtccttgcccatgcctatgtcctgcatggtattacctaagttttcttcaagggtttttatggttttaggtctaacatttaagtctttaatccaacttgaattaatttttgtataaggtgtaaggaagggatccagtttcagctttctacatatgactagccagttttccccgcaccatttataaaatagggaatccttcccacatttcttgttcttgtccggcttgtcaaagatcagatggttgtagatgcgtggtgttatttctgaggcatctgttctgttccattggtccatatctctgttttggtaccagtaccatgctgttttggctactgtagccttgtaatatagtttgaagtcagttagcgtgatgcctccagctttgttcttttggcttaggattgacttggcaatgcaggctcctttttggttccatatgaactttaaagtagttttttccaattctgtgaagaaagtcattggtagcttgatggggatggcattgaatctataaattaccttgggcagtatggccattttcacaatattgattcttcctatccatgaggatgaaatgttcttccatttgtttgtgtcctcttttatttcattgagcagtggtttgtagttctccttgaggaggtccttcacatcccttgtaagttggattcctaggtgttttattctctttgtagcgattgtgaatgggagttcactcatgatttggctctctctttgtctgttattagtgtatgggaatgcttgtgatttttgtacattgattttgtatcctgagactttgctgaagttgcttatcagcttaaggagattttgggctgagacgatgggattttataaatatacaaccatgtcatctgcaagcagggacaatttgactttctcttttcctaattgaataccctttatttctttctcttgcctgattgccctggccagaacttccaacactatgttgaataggagtggtgagagagggcatccctgtcttgtgccagttttcaaagggaatacttctagtttttgcccattcagtatgatattggctgtgggtttatcataaatagctcttattattttgaggtactttccatcaatacctactttattgagagtttttagcaagaagggctgttgacttttgttgaaggccttttctgcatctattgagataatcatgtgatttttgtcgatggttctgtttatgtgatggattacgtttattgatttgcatatgttgaaccagccttgcatctcagggatgaagccaacttgattgtggtggataacctttttgatgtgctgctagattcagtttactagtattttattgaggatttttgcatcgatgttcatcagggatatttacctaaattctctttttttgttgtgtctctgccaggatttggtatcaggatgatgctggcctcataaaatgagttagggaggattccctctttttcattgactggaatagtttcagaaggaatggtaccagctcttctatatacctctagtagaagttggctgtgaacccctctgttcctggacttttttttgcttggtaggctattaattattgcctcagtttcagagcctgttgttggtctattcagggattcaacttcttcctggtttagtcttgggaggttgtatgtgtccaagaatttatccatttcttctagattttctagtttatttgtgtagagatgtttatagtattctctgatggtagtttgtatttttgtgggatcggtggtgatatcccctttatcattttttaatgtgtctatttgattcttccctcttttcttctttattagtgttgctagtggtctatctattttgttgatcttttcaaaaaaccagctcctggattcactgattttttgaagggttttttgtgtctctatctccctcagttctgctctgatcttagttatttcttgccttctgctagcttttgaatgtctttgctcttgctactccagttcttttaattgtgatgttagggtgtcaactttacatctttcctgctttctcttgtgggcatttagtgctataaattgccctctacaccctactttaaatgtgtcccagacattctggtttgttgtgtctttgttctcattggtttcaaagaacatctttatttctgccttcatttcgttatttacccagtagtcgttcaagagcaagttgttcagtttccctgtagttgcgtggttttgagtgagtttcttaatcctgagttttaatttgattgcactgtggtctgagagacagttggttgtgatttctgttcttttacatttgctgaggagtgctttacttccaactatgtggtcagttttggaataaatgtggtgtggtgctgagaagaatgtatattctgttgatttggggtggagagttctgtaggtgtctgttaggtctgcttggtgcagagctgagttcaattcctggatttccatgttaaccttctttctcattgatctgtctaatattgacagtggggtgttaaagtctcccattattactgtgtgggagtctaagtctctttgtaggtctctaagcacttgccttatgaatctgcgtgctcctgtattgggtgcatatatatttaggatagttagttcttcttgttgaattgatccttttactattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtctcctgaatacagcacactgatgcgccttgagtctttatccgatttgccagtctgtgtcttttaattggggcatttagcccatttacatttaaggttaatattgttatgtgtgaatttgatcctgtcattatgatgttagctggttattttgcccattagttgatgcattttcttcctagcattgatggtctttacaatttggcatgtttttgcagtggctggtaccgtttgttcctttccatgtttagtgcttccttcaggagctcttgtaaggcaggcctgggggtaacaaaatctctcggcatttgtttgtctgtaaaggattttatttctccttcacttatgaagcttagtttggctggagatgaaattctgggttggaaattctcttgtttcagaatgttgaatattggcccccactctcttctggcttgtagagtttctgcggagagatccgctgatagtctgataggcttccctttgtgggtaacccgacctttctctctggctgcccttaacattttttccttcatttcaaccttggagaatctgacaattatgtgtcttggggttgctcttcttgaggagtatctttgtggtgttctctgtatttcctgagtttgaatgttgtcctgcctttctaggttagggaagttctcctggataatatcctgaagagtgttttccaacttggttccattctccccgtcactttcaggtacaccaatcaaacgtagatttggtcttttcacagtcccatatttcttgaaggctttgttcgtttctttttactcttttttctctaaacatctcttcttgctttatttcattaatttgatcttcaatcactgataccctttcttccatttgatcaaattggctattgaagcttggacatggttttcagctccatcaggtcatttaaggtcttctctacactgtttattctagttaaccattcatctaatcttttttcaatgtttttagcttccttgcaatgggttcgaacatcctcctttagctcggagaagtttgtaattaccgaccttctgaagtctacgtctgtcagcttgtcaaagttgttctccgtccagctttgttccgttgcgggtgaggagctgtgatcctttggaggagaagaggcactctggtttttagaattttcagcttttctgctctggtttctccccatctttgtggttttatctacctttggtctttgatgttggtgacctacagatggggttttggtgtggatatcctttctgttgattttgatgttattcctttctgtttgttagttttccttctaacagtcaggtccctcagctgcaggtctgttggagtttgctggaggtccactccagaccctgtttgactgggtatcaccagtggaggctgcagaacagcaaatattgcagaagagcaaatattgctgcctgatccttcctctggaagcttcatcccagaggagcacccacctgtatgaggtgtcagtcagcccccactaggtggtgtctcccagttaggctacacgggtgtcagggacccacttgaggaggcagtctgtccattctcagagctcaaacactgtgctgggagaaccactgctctcttcagagctgtcagtcaggtacgtttaagtctgcagaagctgtctgctgccttttgttcagctatgccctgcccccagaggtggaatctacagaggcaacaggccttgctgagctgcggtgggttccgcccagtttgagcttccagggcagctttgtttacctgctcaagcctcagcagtggcggacgcccatccccctgccaggctgctacctcgcaggtcgatctcagactgctgtgctagcagtgagcaaggctccatgggcatgggacctgccgaaccaggcgtgagatataatctcctggtgtgccatttgctacgactgttggaaaagcgcagtatttggacggaagtgtcccaattttccaggtacagtctttcatggcttcccttgggtaggaaagggaaatcccctgaccccttgcgcttcctgggtgaggcgatgccccgccctgcttcggctcaccctctgtgggctgcacccactgtccaaccagtcccagtgagatgaaccagctacctcagttggaaatgcagaaatcatctgtcttctacgtcgatcacgctgtgtgctgcagaccagagctgttcctattcggccatcttggaatggaagtcaagctatttttattatagaactgactgttcaatatttaccaacataccactatgtacacctgagagaagtgagtgcatatgtctaccaaaggctatgtaaaacaaagtttatagcagttttaattaaagaacaaccaaactggaaacaacccaaaggtccaccaacaggagaatggaaaagtaaattgtggtattttcacacaatggactactacacagcaaaaataaataaaaataacagtattgataagcacaacaagatggataaatctcacaggtcagttaagtagaagatggcagacacagaagagtgtattctacgtgattccatttttaggaagctgaagaataagcaagactagctgaagttgatagagtcagaatagctttcctctggggatagtggggttattgactgggaaaggacatgagagggccctctgggtactgtaaatatgctatgtcttgatctgagcaatgtttatgtgtatctatatataaaaattcattaaatatgcacttaacatttacacattgtactgtatataaatcataccttaattatgaagagtgtagacacacacacacacacacacacacacacacacacacacacacaccgtattcagtgaccctgtcagtaaggtggaagagttagactaccatcccagcagtacagaacatccaacaatggtgagtaccaagaagaagaaaggcagcctgaatcttggcagacaaatcagcccagttttagtgacatccaactcactgccatcgtggggactttcagcacctgtactggcagcaatgccgatgcatggagaatttgtctccatcagcacatactccccaggcacatcactgcctgggaaggaatccagtgaacacatcagctgtctctcccacacacctactgccataacagcagaaatccagaaatgtaaagatagggactttcatccaacttgggcaatattccagcatttgctgtcaacagagaacactgaagcctgagaccttacctgttgagatgatccggaaggttgcaaagaggcttctaactatgtctctaagcttttattccaaataaagtaaaagccaaacaaatgcctgcttcctttatcatcagccagaagaaaaataagagatcatgccatctcacagctctccattcctggcaggatgcaggtctaagtacttcttgaagagttacggtacattctcatcagcagtgtaccctagacccaacaagtgattagccttaagccttaatgaaaagactggactgtgtcccaaatgagggtgaagtgcagttgacagcatcaggccatctacactcgtgaacttgtttgggccacttggagaaatatttattgcatacctactgtgttcatcgtcataaaaatgtgcctaccatcaaaagattgagtatgaagagaagctcacaagatcctagctttattccctaacggttgagtgttgtgtgttcaaatatggctgtgtgaaaataatacaagacattggggagttggttttagaatggcttagtgttttgaggacactaggaaactcgaattccagaggctatgagaattattggacattttcttagtttgtgtttcagaagccaatcctgaaacaagaaatcaagtaaaggcagcttacttgggaggtgtagggcaaacagaacggagcagaggggagagaaagaaagaggaaggagcctaaaagggcatataattaagcaggccacttctgtgggcaactagagcacagtcacactgggggaagctctgggaaccagcttacaacacactcaccccaaagtgatcccacccatggggagggagctgggtatttataggccaagtcccatctgtcattggttgagggatgctcctaaggagtgttaattccccagcacttctggcctgccaagcagatggtgaagtgggctctgtgacaaagaagtgtgggtgctggcatttgaagtcgggcaggtgtgctctcaagagataagggctagaggatatgagcagggtgccaactgcatctgctgcagaggaacttaaagcaattggccaggaacttctctgcttgtatagtctatgactgcactttagaagtgtacatacagaaaattgaaaagccacacatcagctaaatctacatatctataaatctacagttgatagatggcacattaagacccaaacctgggaaatgcagcccaaatgtttaatcagtaccatggagctgaaagttgtcatcctgttctattacctggcttattgccttggctaagctgtccagatctataaaaaagtaaaggcataaaccttctgtctccttcaagctagtatgacccccacggttcagaccttcatttcgtcagtgaactagttgttacattggtgtcttattttgtctccctggttacactcttcatcctttccaatgtagctaccacactgcaggcagactgaacttcccaagacacacttctgatcatttcatccgctgataaaatctttgactggctcgcagttgcccacaggacaaagtctgtcttccaagttcaactaacaaggccttgtgtgattgggactttgcctgcccctctggctttcctctccgttttcctaccagcctgaattacttccatttcccctgacatcctttttgtgcctctgaaactttgcccatgccttagcttccacctgaaatactctctcaaccagttccacgccctgagccaaacctctgcccttaattaactcttcctcattcttgggtcctaatttagaagtcagttcatctagaaatcgtccttgatgactgcaaggccagtgtgggtgcccttcccttaatactctgcacttcttttgtcttagaactccacaaagattttgtagttgtcttgttgcttgtctttatctcccacagtttgaattttctgtgagggcagaaccatgtttgtcttgctcacatggcttcaggtaagatttactaatagtaactaataaatttcaatgaatgaataagatcctccgtcgtctgacccctgtctcctttccagctcttattctattgcacactcaccactgctacacacatgctcctggtacacacacacacacacacacacacacacacacccctgcatccccctcacatatgcatatatcctggacaccaacatactagactccctatacccctttagctattcctatcatagcactgtaacactcactggactttgtggttcgcttgcgctaatcaattctgagaatctgcctgaagtccctccactaaactctacgttacttgaagataaagttatgtcttaatgttctttatctctccagggcttacgtaatgcccagtatggtgtagtcccttaatatatgttgagtaaatgcatcattgctataattggtgatgaagtgcagaagactttatcagcatgacttctgattctcaacaaagcaaaaaacctctggcctcccacctgcccagtgtctgagacccatcacagacttcacatctgcaagccttgaaaattttcattagccaaattagcaaaccattgtcaccattaaagcaagatagaatcaccagagtgacacctttggacatgaaagcaatctttgctccgggctgggcatatcacttccaaaagccacatgccagtgagacagcttagtagaagctatctgtcaatttcagtagggctggcgtgctcagggaaggtagatgaaatgttctgagggtcctatggatgcactccacctctaaagtagcaagcaaaaccaggctgcaggataactgaatcttgcaaaaacatccgagtcttgacgtggaaggaagttgcaatagtgggagcataggtgtggttggaagtgattacagacaagaggagtttttccaaattattttcctggagacctttatgatgacaggatagtatcacgtgcaatattctaggttccatcagcagcagtgggctacaaaccaaaggactgtcacctcaggtcggctgtgaggcataagcagatgaagttacatcagtgcttgcatcgtctgagacatccagagataggaagggtatacaacctagtttgcctgtgatagtcccattttatgcctattgttcctgtgaaattaacactgccctcttgcactcccaaaagtgttccagtttggatgataaattatatggtcacactacccatcaacagcattaacaggaggagcagaatcttcagatagacatggatggtaggtacatagaaattcttacaatagtctccagacttctgtatttaaaaaaaaaaaaaaaacttttcaaaataaaaggaaatatgaaaaacaaatacacttgaaaaattcaaactaccctatgattaagcatagcacataattatttcagacctcagttgcctacctaaattgtttctctgctcttatttttttagattatagtttaaccatatccatttgtctaatgagatcagccatttgtctgcagcatgtaagcaacaggagcaaattcaatgtcatctgtttatttaagatgtaaatgatatgcatgtagcacagtagcctttgggtacaaatgaagtatcattcaatgtcaccggagaaatataaatcagcaagaaggaacaaacactaaaggtttcatcagcacatctttgttgtgctccttttatgtgccaggcactactctaggtacttgggataggattgagcgaaacaaaatccctgccgtcgtgaagcatatatattctagtgtaaaactccccgtggggagagatgatacccaagtcctataagacccccaacttcaatctgatattttcagtaaatccacacaccgcaagcccctttatacaaatatgttctgtaaagttttgttttgtttttttctttttcgtcgtgtgtttctgaggtcaaggggttatataagaaacatacatggccgggtgcggtggctcacgcctgtaatcccagcactttgggagaccaggacgggtgaatcacctgatgtcaggagttcgagaccatcctggccaacatggtgaaaccccatctctactaaaaatacaaagaattacccagacgtggtggtgagcaactgtaattccagctactcgggaggctgaagcaggagaatcgcttgaacccaggaggcagaggttgcagtgagtcgagatcatgccattgcaccgcagcctgggcaacaaaagcaaaaatactccgtctcaaaaaagaaaaaaaagacacatacatgatgcaaaagatgctattttgactgatgaaagtcttctcccttttcacatctgttttcttcatctccagctgtttgcgcatgcttgtcattggtgatgggcttgtggcttctttctgaggtttctgttgtaaatatctggcattcactgggttttactgtttagtactggtcggagttttgttgcttttctagactgctttgtcatgtttgacccccgactttgctacctcatcaccatctcctgctgtgagttgaccacgtttaagcctaataccagaaagcaaatttatcaatatccaaatgtccaaagcacagagattaggggataaagtctttacttttccagaagaactctcattaggggacaattttctgagcccaggatttaaatctgggctgatccacttactaaatttgtggccatggacaagttatttaagctcctagaggctcagcttcctcacgcgcagatggaggggtaatatctacctccctgatttgctgtgagggttaaataagatgatagattgtagcattctttgcacaatgtccggcacttagcaagcacttagtaccttttagtttccttcttttacccctaccatcttttcctgcctagactggattcctttaattgatgtgcacagttatctaactagagagctaacctgcagatgatgggacaattttcaaacttggagcttatactgggattaaggagggccaactttaaacacatactacccagctgttcccttcaaatatttgtactgatccatgcttctaaccccatttaccccttagtctttcagcaaagatgagagcaaaaatcggtcacctttacatttcattgaatatacttttcaagaaaaatggaggaagtttcactatttaaaggaaaagaaagttgaagtagacaagacacaacagaagatagaaatggggttttctgtttgttcattttgtctttgctatcagacatttactgggtaccacctgtgtttcagagactgtacagagcaatttacattcaatttctgatttatccttcaacaatcctaatgagatgggtactattattggccccattttacagatgaataagctgaggcaagggatagccattacataatagcttagtgtccaggatcacacatctccttagtgccaaagctgggatttgagcctaggcagtctgattccatcatgccaaaccatgccaccaacatcagcacctcccagaagggtcgaggcctttgcaagccgagtcatagaaactatcatagtttgaccttttgccctgtgagacctcttttcagatcaggaaagggagggcagtggctgaaatgctcctgtgatttttaagggcagtagctttgtatgagaaccttgagaacagagaagaattattgtcaggaagaaatgcactgtcctataatacgttattttatgaattacaggtactcatccttggtaaggcttatggtccatcattaaggagagctgttaccatatcattaggtggaactttcttcttattttttctttcatcagccataatttccattgttctcaagttcagtgcccattagaaacatagcaaatcctttcaaagaaaaaatgttaccaaagagctcatctgatgaagacatttgtatattttttgatttaacagtattattattcagtttcaaatatcttggggatgtgggttatatggcattttgatttttttcataagttaaaacgacgggaatgagaagatttctgagatccttcctagcccaaaactgttgtcttttttctaaaatcctgccctgataccaccaaactgtctcttggaaaccaaacaaaattgtctgatagccccctcaggaagctcaggttctgacaggactcttggggaggaggagaggcaggaggggaaagaacaaacactgacgaaagctcaggtaggtgactcacataaaattgccgctattcaactactttttaacctatagaaatggcaatttcatatggtttaacctaatactaaatgccaggccagacaccttttataggtaatcataatgactttatgaggtaaggattattcccataattcagataacaaaactgaattaaaaatctaaattcactgtcttagttggacctcccccagaagctaacctggagtcaagcacttcatgagagtacaatatttggaagataatcccaggaagcactgagaagagaacagcatcatgaggcagggaagaaaagccgtcggctatggaggcattgtcaagccagctactctgtgggcaactggagtttaatcctgctggggaactctgggaaacagtgaggaacacatgttgtagggttatcccatttaggaggacatgtgagctgggctgttcatacacagactgtctttagtcataggtccagcctgcttagaattgagatagtatgttagtgccccagtatttccacatcaggctggaaatagatatgatatgtgcactgaagtggtaaggatgaggggatatgcgcagggcccagctgtgttatgaacagaggcaggatttgaacttgtggcattctaacctcataacccatgtccctcccacaaaagcacaagatattgtcaagtcgggaaggattaggggctccaggactcaattgtagattatgtttggaagctgtaagaccactcaccagaggagctagcatccatgcttcctgctgtataataatacaattgtatttgtgtagctctcaaaagttgacaaaatgcatgcacactcatcatctcatttggctttcatcatgcccatgatgagacaaactaaagtccctttactcatgagattattatattcatgtgtttacttcacaattgttatgtgttccaggcactgttctagttaatggaaatgtagaggtggaccaaacagaaacacattctggcatgacagaactcatatttgaatgggggcagcagaataaaaacagagatgatgataatgtcatgtcatgatggtaccatgaaaaaattaaaacaagaaaagatgatggtgatgggcaaacatactagtgtttttttttttttaaattaggggtgagctcaggaaagatgattgcatttaagcagggaagtaaaggcagtgagaacagaagttttttaagtgtctggaagaagaatgtcccaggcagaatcaagagcaagacgagcactgcaatgtgagaatagcgagatgggagtccagagaagagaggtcagcaaggagaatgtttcatgtcaggcgccaaagtcaatgctctgagcatgatgaggaactctaggggaatttaaagcagggaagtgacgtgttttcataggttcattgttttgtttatctctaagtcatgtggtcagcaaaacccagaaccaggactaaaattgaagccttctgactcctgatacagtgctcctcccattcaggtccatggttggtcattctctagacctgaatgtccttggcatgctgtttttcctgttcctggcatggttatttgtggtctgctaatcaaatcttgtaacagctgttgcctgttcccaagcccaaacatttggttccttgggactttcctttgccatttgtccagccaatcagctttaacattctcctgtttctgtgagcatcgggtcctcttagagctatccaacaaaactcttcacccacaagctagctcaactacagcttaagcttgaccatgaaactcaagtgaggatttagggaatttaaaaatagccactctatcagccactctaaacattctaatcagaaagttcaactttacagactgccaagtatcttcataatatgaaggattttttcacaaatcaagaccaagtgaaattttctcccagactacgggaataaagagattgttgaacctgtggttcactgtactgactgtcttatccataccagtgtggagtcaggcagaagttgcaatgagatactgcaattgcattttccttcaccatcactattttttgtttctaaaatctcagatttctctgcttcaaatctaaagctgccttgttttttcagccaagcctgcaaagacaaactcagcttgtttggagagttacaataagggctgtcttggctgcttttcagtgtcagtacccgcaataagagtgtttaccaccttgtagagtaaggagcaaaacagaactattcaactctcccagacctgcactagcattgcattactgacagaggtaaccatttgtcttttgtcactggagcaggtgagcatggcaccaggcacacatgtgcagaggaagtgtgtggatagatagtcacttgtttggctatatccacagcttaaatttggtgtcctctggaaatgtaatatttcaaaggcaggatgatatttctgttcacttattaagggatgactaacttgcttttggctgcactacaaatgaatcacggtaacaatccctaacttgcgacttctggtgttctgatgtaatgcatttctattaaaagaagaggaaagagagtgggtgagagtgagatcatgcaaagacagaacataacaccaagggagctagcgtaatttatgaactgctgcagccagatccatccacttcaaggtgttttcttgcgtcctgagtgaggataccttgccagttagcacctgcccatttacagttgcagaatatagacccagatcaagacatgtagtttggagggattcagtgaagggaacattttatttaggggtgaaaaccagatattccttgaaagcatttttaagcagttttgattgtgtcacttggaaggtaatatttggggacggatgatataggttaagaagtcaaatcataatcttcctttttacatttttttaatgtatgcagcttatttgggagtagaagaagtgggaagggggtggaaacgtgagacaaggaagggaagacagcctataaagggggtgtcatcaggctaactcccactggaggtgactggagctccatcctgctgcgacatggggaacccatacgaactccgagtcttccctcacagatgagattgcttggggactgtttgaggctgaccccagagcatgttaattgccctgcatgggcagagtggccttcctccttccctcctcccttttcaacaagaaacaaatacaaaaaaaaaaaaaaaaaaaaaaaaaaaaacccaaaaccctgcaaggtattgtataagatcctctaaacccacaggtatttttcctgtgttaatcaccactcaggagcagatacatccttcctcccttctgtactgtcctctgcaaagtgtccctgctgtcttctgaggaagatctgagtgtgccaaggagaggcagagaggaaattagactctggcctgtcgtgaccaagcagcccacactggctttgtcccaggatctggcagaaggggattataagagccaacgcctccccagaatgggaaatcactcagagagggaaatcttttttttttttttttccagtaaacctatattctttaccgttttccttctgggtttcatctatcagatcggattgccctgaaaaagaacttcagtgtgtcagaaaagcatacctcaagtagccgtaataatgttcaatttgatatttattaagttaactttctctcacctggtgtctgattatgtagtttgtggatatcactcatcttagaattatgtagtgttaaaactggaagggtctgtccttaaatattagctagaccaacaccctttttaactgataaatatgagaactgaagtttcagacttaaagaagcagagtgggattcctgaagtttctgacactcttaaggtaggtagtggaagcgacactggaagccaaaactttttcttactggattccattgtgccccaggaccttttttcttaggaagcctgtctttgaaaagctttatttagcaacaccagaggctggatggagattaagaaaaatcgttaaactctaaacccatccccttcgttacctgttaatactgccatgtaatgttgctgctgtctgaacatgagtttagctgtttggattatttctggtctctcttattggaccccagatctccaattgtggccatcccatagctcaatcatatccactgccagtcacttgaagcaggtgggctgacaattcttttttttttttttttttttgagacggagtctcgttctgtcgcccaggcgggagtgctgtggcgcgatctccgctcactgcaagctccgccttccgggttcacgccattctcctgcctcagcctcccatgtagctgggataacaggcgcacacaccaccacgcccggctaattttttgtatttttagtagagacggggtttcaccgtggtctcgatctcctgacctcgtgatccgcccgcctcggcctcccaaagtgctgggattacaggcgtgagccaccgcgccgcccggccgggctgacaattctttatccacccccaagttgtcttcatgctcactgctgaatttgttggtgtatgctaagtgtcctgctgtggagtaagacttgagaatcaggtctgcccttatttactggctcatctcaggtaagtgattgaaagtctctaggcctcagttgcaacagctataaaatgaggataatagtatcaccattgccacagagtctgttttaaatacatttttcaactgtatagaaagcacttagaaaactaattactattatcattatcattcttaacctgaagaatgatgagagcaaagaagctaataatttacgtgatgtgttcagagccttaaaactaatctcaatctaacattcagttttggcctctttggcagcaaatacaataacaataaaaaatattgttattgaaattgacactggttcgggctttactagtacaaagcacttggcgttgtttactgttaggagtttccctttgttttggacactgcatctcatgagattttttccacgcgcgagtgcaagcacgctaaattcaggaaaattatcctattattgacagcatagtagatttgatgagtacctgttgaatgtgtgttgaatgaataatctagaatctatacatagttatagaaacatggattatatgttatttcacaccacagacttagaccacattaagggtcaggacaattagtttgtgtcgttttttccttcgttttcttttctgagaagagcgtctcttacctagttcaataacaagcttatatggatcgcagttgtccattttgtggattatctgaagcatagcttcaaaccctggctttcttttccctctgtgaatatatctggtactacagtttagaacatccactaatgtttctactgccttgagtggggttcttttaggaaagtaaatcagggcactctaaaactcggtataggtagatgttcaggtagcatgcgcagtatatctgcccacggctatgtggatttccaagagtggattgtgtctgtgcttatgtgtattcataagcaccaaagatcagaactgagccactgcagaagtcacagaagggagtctcaactccttattataactcttgttatcctctcacctcttattccacagtagaatcctacagattccccctgctaggtgggtggcctcagccaacaccctctctctggctgctttgtcactctgcagaactctgccactcagaagcaagagtgacatgttctacccaccactctgtcggaaagtcaaggcagttgcatcttacagcagctctggaagtgagttaagaaaccttccctctcaaacttcattaaggttctcattttccaagattccctcctatggtcttgtagtacgcgggttaacatggtgtctgttttcttcgatgtatggtcctggggtcatagcagtagatctgcacagttggaagatccctaaagagtttacaactccccacccagaagggcatggccgtcatagagaatggatggaaaatatccccttgctataattgggttcagccctgtggcttaacaccatcttatttggcaatctttttctcttgacatatttagtaatcactttaagggagatttattacactgctcatgggaacaaacaatgcactaaatattacacttaggcatgctttcaataccactccttttctagcctattctgaatcttttcccaaagtctttcttcagtgcttatcaaaactctctcttgtctttaaattcctctaagttcttctttcttccaaaataaccttttataatttgaaatattttgtaactaggagttcttttaatcaaaattcactgggccatgcttagagaagaattgataaaaacacactttcacagcttaaaatcatggaagacattttgctcaccattaatcccaaagcatcaaaacaaacatttagcatatgattaggctgtgaaaatagcctcctaggggtgtgtgtgtgtgtgtgtgtgtgtgtgtgtgtgtgtgtgtgtgtttacatatttatataaaggaattcaaattatttcagccaaacataatacaatgaaatgttttctgatcctgtgggttggtacccatgaagagatggggggcaaggggccactgagaattaggattctccactcatgctctgtgctaatgaaagcactttgacagctagtgcccctcagacattgttttaaaagcataatatcccactcatccaggcacatgcgcagcaaaatgtcttaacagatagtctatttagcacagatttgagagaaaatatatcaggatcatggagaaggtaatgagttgtagtggcacagctacagtataacaactctgtgcatgttaaattctagcttctttacagatgaaatgtccttcattcatcagatatgtcataatggctatctatactcttgagagagtccactcagtgctaagcacagtcgtagatgtactagtttacttaacactcaactacatgtctgtcactggcctcattttgcacacgggccacattttatacagagaaagcaaagccaccatgaggataagctactggtgagtcaaaacagttaaactaaggacctgtgtagctaccactgaaacagtaacatgatatgccattttcaaaaagacagtgatgagccccgccattcctcctacctacatggcctccctgagccccagttttcttatctgtaaagtgacttgttgagagaatttaaggtgtgaagccctgacacgtggtagtagctcatttaactcccttactcccaccacacccctcgactaccttgttttcttatcttagacagtagattacacatactcgtacatatctgaaatagagcatttgtgacttttaggagtggggcagtaaaagcataaattcagaaattagttgctaacaagaaccttaggtattcagatggctagaggtgtatggtgaggggccaagagcacaggttctggagccagactgcctggtatagcccagctctgcctcttactatgtgtgtgacattgggcaagtgacttggcttctctgtattgcctcatctgtaaaatgaagctagtacttgaacctactttgtaatttgctgcaaggattaaatgagtttatctgtataaggagcctagaattgtgcctggcatgtagtaggggcagttaaattagtgcgtgtattctcctgcatattttgatgacaagcattcagtacctgggcacagcaaattcggtatagagcaaggtgtgtagaataaatcccattgttctcctttagcatgattcccatatatcccagccaggctcttacagttatagctcccttcccatacatgtaggcaaggaaagccagagacaacaaggaccctcaaggtaaacctcttgtcttatatggtagagagagacttaattggatgaagagatcatttagttgccctgcaaatcggcattaaaggacgagccagcagaggatctctgcatttggaattgcaccttagttcactttctatgttacattttcaacagggacactgaacaggggacctatataagacttcccaacagtatagaccaattgggtcacaaataaagaacacgtggaaagaatactggtactttaatgcagcatttctcaaatgtcagctgcatcagaattcttaagagggcttgcgaaaacccagattcctgggctacaccccagaaattctgatttaccaggtctgggatggtgcctaagaattttcatttctgacaagctcccaggttatgctgctgctgctgttctaggggccacattgcgagaaccactggtcaaatgtgtgtttcacattcctactacctatttctgatctaggtttataacatttgatttgaactgtttagcttagagacggaatgtccaccctctccaaaaaataaaaatagaaatatttgattaataaatgctgtcatttttttcccccacagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcactcacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgttgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtaattactactcttctttcttctgtttccgcctgctggtggtgttgactaggttcctaaaaggccaggagtagccttctaacaactttgtttcatttaacagtatcttcattttgcccaaaagtcctgggacccactctataaagtgctggtaatcagcaaaaaacaacctaatctggtaaatgtgccagaagttcaaagtcctgggttctagcgctgactctccattgagcagccatgtggtgtctagcaggtattaatcttctccttgtcccagtgtcttaggttgggcttccccataagcagggccctgagaaaaagatttggatacaagtagtgtatttgggaggtgagcccaggaagcaccagtatgggagtgaggaagtggaagttgaaggcacttcagttgaaggcaggcagttgaaggtatgttaatgagcccaagatatatcacattctgccggttgctgtgggcacctgtggttcagccccacaggggacctttgggagaccttgtgaaacacacctcagagaggtcctcccccggggtgaggaatttgggctattttcccacagaccctttgtgattcattgagggctgctccccaggccagttaactgccagcacttcccagggaggtgctcctgcagcacactcctgcagccagagaaatccttcaggtgactttgtagttataagccttcagcaagctcaagaatggggaatgggagggcatgttgggttggcactgagagcgcctgctactctcagtttccccaccttatgaatagagtggatgtgagcatcacacaaaaggacatgataaatgtataagaactttgaaagtgacatgtgagataccagtaggaagtaactttttttcctattcttactatgaactcaggagaatattttaaagcgatgctgatggtgacagcgtgcttccagtgtgtccactcagggggctgctggaactccctgatagagattaatggtcaaaacaaagccatagtggccataacatcggttgccctgtccatctgttatcgaaaatggcatgcccagcaagcctgatggcagggttcttgcgggccaaggattcaagaggttcactttcccccttttctatggtagcttctcatcaattcctttaacaaaattaaaatgtcatttggaatcagatactcacatgacaaatgaagtggcattttttggttaactaagaaataaccactgttgaggtcattagcgtgccttatgccctgttttagagtagtggaagagaatttcctcaggaaatctccgctgtgttgtgagcacacgataagcggggctggtggggctgcaaagccacagaattacattctgccctcgattctctgtggcccgaggaattgaaacctagtcaataaacatatactagtagcttttgtgaagagctgggcactgtaaggagaccgagcagcctgataatttgataatgtacttgtcactgctgaaaacaacagagaagaaggctgccgtacctcctcctgaattcggtctattaagaaagcagcataacctgccgctttaaaatcaccccaagaccgtgtgggttgactgtggaatacagagtggttccttgaagagtgagtaggactgagtattagtagcttccacagaggcttgtatcaaggttgaaattaagatgttttgctcatgattagtcacaatcttgaatgttttgggggttacgggaagggttttcgtttcgtttcattttttagcttttcattttcttgctgcttttgtgggaggaagagaaataggaataagaaaagagtggggaactgaagggagatcgtaaggttctcaaggtgaggcaaaaggacgccggagctagaaaaaggacaatcagtgctgattttatgacattccaggttgttaccagtgagctcaaagcatgttagaatatttaaaacttgtgaaaagttaatttactaagtaaaataaaattataatatttaaagtttcttcaaattaattttaagtaaactaaaatagcagtattcaaaacttcgtttcactaaaaaatgaaattgtaatattcaaaacttcttaaagttagttttataaagtaaactgcaatattttaaatttcttaaaacttacttttttgtactttttaaagaggttttaaatattgtaaggcaaagtcaacacaaaacagaccatggcagatagtattggtgcagggaaggatgtaagagatggtaggatggaaagatgctgttagcagggaaatgtctttaaaaaacaaatccagaaatagtaatgccacagatccacaaagactgagtatcactgaactttacatcacagttcaattcagaaaaaatctagcatttgcagcgaaagagaccacgcaccacaggtgcccaataagcccttgtttgcaatttctgaggaatgttacgtgcattgatttgatggcagttttccctgctgacaatcagtgtgcaacctttctgtacattctcagcccaaagagttctcaaattacttagtcataacatgaaaggaagctacatgttttaatagctaaggcccatttacaataaacactttgcacgatgtaatgggtgcttaatatgctcataaagctaacagtgcctggatttaggatggtcgccctcctgtatttctcagataaactcttcatttttaagagtttataaaatgaaatataagcaagaacagcttcataaatgttgcattcaaggccatcgtttaattctggggtttttggatgaccagtcctaaaatgccagtaaatatttcaaatgaccaagaagaaatgcagtgctaagagttttggcactacagtaaactgtccagtgtttaaattttcctgtgtataacttaaaatggctatgcttaacctaagcagatttaagcaaaacttgatttagtatgttatataaatacaatatcaaatcaaaaagtatatagcctcatttaaaaggtaaagtatcttagaaaaagtctcaaacatggacatttccttggctatcaataggtctatactgtgataaacattatagatttaaaattcaacaaactgaacattgtcagtgtgattctggtcacataggccaaatccagccaaatgccaaaatgacactagatttagaatggaaaattttaagatcacatgtgtcaagcagtattaacctgacaaaattccagaagaggaaagaatttggataaactcttaagagttcaccataatgggatgtgactgtgtgtttctagccaagatgatatgtgacagttctggcaataagaatatatcctacacagatgaatcattttggcaatgatgtaagcatagatacatcatgatttagaatgtttttaatcagtgttgtgcatactagacaatcccacttctgccaaaacctctgtccagatgagtcatatcagtttatttagagctgaaatcctaaaaggtctacagcgttataaatgttcatcgacattttttagttactctaatttggagaagagtttatttggtctatacccttatcgtgcataaaataataaccctttccaaatatattgatatcaagtagtgagttacttgaattgctacttgtgaatatatgatgctaattattttaatctgtgatggaatttcctttaaaggatgaagatttacaccattattctccagttgggtatgatttttaaaattagcataggttttctgtgtgcaagctctccttacaggcttaatgtttcaacagctttgctgatcagatacaaatcaggaaagggatagaatgttagatgatgtagaagggaaccaaaagaaagttttctcccttctgcatctggaaggtttgttgcttcatgtacatcctgtacagctaaaaaggagaattgaagtcgtagtgaaagagttcggatattagtttctacatgcaatctagtttataaaggttgctttgcatttatcaagatacaagagccccagagatttatgagataaaaaatactctttaagccctttttcaaatgtttgggattttgaggtcagatgtcagatccagggtgttctcttccttttgaattatccaaccaggccactcagattcaaggacgtgaaaggaagaaagaattagtggattatttctaatttgcggattagtgctaggaaaagaataatagcagggaagtttggcttcttttagctgtgcattttaacattattcatatgtagcagaaaccagaagattgggttccattctccaagaatttgctctcatatgatgccacttgaaatataatgcagtatatggagctcataaaaagggaaggaaaaaaaattctcatgcaaaacatttagttccaactgaaacattgaaattcttattttttctctaaacttaagcaaacctgaaagaatttgctttcctgatgagtattctgatacatttcaaaagtcatgagaaaatgagggaaaaatcagtcagataataataaaatttaaaccatatgaaattgcaaatatccaaccatttttggcctacaaacttggtaccattatctggtcatttttgagctacaaaaatggtaattttgtgtggttcagcctaacacattattgtagaaatccattatttgcaacaatatgacaattttgcctgatggagtagaagtatattagaatgctatggaaagactttgcttagatataaatcagtaataggttcagcatgttctagagaaaacaactgatttatgagggttttgttgttcacatttttgtgtacatctatttttttaaaagagatcatttattttacagtatttccaaagtttgtctctcgaatatcgttttttgtaatggtccatggtcattatgggactaatttacaaggagattatgtaatttaggcttgtaattcgttcttgcccttttattcttatgctccaccaatcatattagggtgagagtaggtggaaataaataggtttaggggaatggaacaaaacaagttttattgttctatttttaaccataaagtaagacaggaacaggacttgggggcacaagtccaggaaagcagaactcagtcagaggaatacaaaggggctttgtctttgacccaggattcccagatatcccctgggtggtctgtctacccggtcgtgcccagggaatgagggagtgacagaccctgtaaaggttgggcagcaagaggcaacatcaggacactgaactaaacatagaccctggggagaaatacctagtatctacatttggactaaactctcagaaagtcacagctgggcagtcttgaccagatggatatacagaagctcacaaccgaaacaggttcacagttattgtcaaggaaaccctgcatttcaccaaggctactttattactcaagaaccaaaatatagacagatggagcccaacagagggattctatagccccttctctacactgattggtgtagcaacactaacattattttgcctcatcagtaaaataaatttcacatcagcctactattcatcttgtgtgtatgtgtgtctttatagcctatgtgcataatatatattatatatcacattagctgtattatatatcatatgcaatatgatatgtagtaagctcatgttatgtatttatatgtatacaatgtgtttataacatatattatgtaatatatattgcttgaatatttaaatagaagctattctctgtgtatactatctggtatataggagtccaacattttgtatgtaaatatataaaatatatttgaataggatatgccatatatacatatgtttatatatcacatttgtattctatacgaaaagaaattaagcaatgaccatagcatatattatgggccacatttatacttatacacactggtcttatataatgtacatacacacaatatctaaatactttaaacaaggaagagctataagcaaattcatttctagggctctcttttacagctatctagtgaagaaaaatcattcctaagactaaaacccaatgctctggttagaattttcaaaatgtgacaagtctctagtacaaagaataagatgtgtgtgttccccctgatgtgagcatctgtctttacttaaacagagtacacctttattcttactcttaactctgagacaaaacaggctgcaataaaccaaacaattcagcttgtaaagtaaatgtttataactggcaaagtgtaaatgtaacccaattaataaacttctccctgaaaatagatgttactcaacccagacatatatacactttaaatttcttctcaaaaacacaaaaatcatgaatttatgtggatgacattgaaaaacaggcatcttataaacatgagctacttagtgaagcttttctaagaataaaataggctttaagcagattttgcttatggattatagtctctgaatttttgagacgaatgtagtaattttatttccatatatgaaatttggcactgcccaggcatgctataaacagcttcattgactcatgatattaaatgttttcacactgaaactgaaagatcatccatcaatcagcaagccatcccatttcctccttcttagccattccttactttgaggaactcaggatgaggaaatcctgctagtgtggagaggtttaaaatgtgagtagcacccagcggcatctctcagctgctgtgttgtggctatgtatactgggacaggcgcgaaaatctgggactgaagaaaaatctgacttacaaaatccagaagtattatacaaagtagatcaatttgcctacgattattcattgaaaaccaaacaacaacaaaaaaatcacccagactgtctccaatagcaaaaccactaaatacatttaaaatattattcactttatgagcaactttccagaagtatatctactgggtaaagaaaggttaactctcaactatttgttagtagattctgtcttaccggattataaacaaccctgaaggctttggtcaggccccagaaagttctgggtgacagaattaatctctgagggtgcttgatagtcaccctcagtgatgggaggattagccagttgaatttttttttccgccattagtgttatttatcatgtgtgcttctttttcccttcatttgctccaaagtctgagagttaacaacacattcagatataaaaattcttttgagaataagaaaaattattagcctaaattctttagtattttattttattagatgacaaccccaaagtgtactgcaaataaaattaataaaagcagttttctttttaaaatcacactcccggcccaaattttgcctcaacattagtgaagagccctgctggcctgacaaaaacctcgagctgcctcagagtattcactcacgaataattagaacttggcgctcccttcaatctctctctctctctttctctttatgtgtgtgtgtatgtgtttttacatactgatatgcatttgttcttatgcatgtaacaatacagacatgcagggtaacaaaaatagaaacaaacatcttgaatatgcttttaaaggacaagagaatgctttagaagcatttttatcttcaaaatctgatagaatcagtatgtgtttaacagttcccgttggcaactcctcagtcctgcactgtgactgtaaaagaaggaatcccctgggatgttgtatcatccagggtaatccttggaatgtgaggatgtcaggatgtggaggttcctgatatcctcactgtgatatatagtctttttaccccaaggtctcaggctgcgacctggccctcaaatgatgagtcatgactcccaataacaccacagggtccctactgaccaaaatcaaaatctgtatttaggtagctctgccctggccccaccccatgagttctgtcaccagggagtccttgtgaacagacttgggactttggagatgggaaattgttatttgccaaagtcatgctttgtgccaatgacataggcccactggtcagatttaacagagaagcttatagaactcctactttgtagagaagtttttaaaactagagtgcaaagcaaacagcagtacttttgcttttaaaacacctttttaaaaagtaggaaacaacagtcagacctctgaaaagtatcttcagtccacatgcaatatctgtttgcctacgtctgtaagatttggcgtcagagttccgcttgctgaactacagccccaaaattaggagagtgggttgtgcgtggtggctcatgcctgtatagaatcccagcactttgggaggccgaggcaggcagatcacctgaggtcaagagttcaagaccagcctggccaatacggtgaaaccccatctctactaaaactacaaaaattacctgggcgtggtggcatgtgcctgtaatcccagctacccaggaggctgaggcaggggaatcgctggaacccgggaggccgaggctgcagcgagcagagattgtgccactgcactccagcctgggagacagagtgagactccgtctcgaaaaaaaaaaaaagcaatgaatgatgatgatgctaaaggaggtagccatccactgaaagaggaaagtggagaggaacagaacctaccaaaatctatcttctctgcctctccttgactccaggtggcccagtttctggagtgctagtaaaagataaggtcagacctgactgaaggaaaaactgaagaaattcgtctctgtgaaattctcctacctgccatttcctctttattccattcccatgtccattctctgtcccattccccagacctaagggaagctgcttcagtagaccactgtcccagaggagtttacatttaaaaggatacccttgaaagttccaaggggaactcggatataattccggcattctggagggcaggatggtcctcgtgtcctagggcttttggaatgtgtctccccttgaatccaggccagaacacaagagtcctcaccgatggcctttcctataggataacaggccgacctcttcagcaaaaatacccagctatgagccaggacagctgccagccaggcactccaggctgttaatccttaagaggtgaccacagctatgttagcacttgtccctcccttgactgacaaaccttcaggaaggaggcccagttatggtatcagcaattgtcccagaaatccaaagggctcttgtaagatgctgtagaactccagtttggggattcgggtgtagcaatctgctcgagaggtgtggcttgagaaaggaatctgacctatcaggaatggtggtcggggcctttggaggcaaagtcaggcacaactagcaacaaatgctgagtgatcggttagaacaaattctttctcagggcctcttctgatttctgtgagtggctgcatgtacacacctgtagcaagaaggaagaactaaggaaaggcatcgtttccaaaagcccctcagaagaaaattagaattctctttggagctgcccccaaaccaagaacatatgcaaaaagagccaggactcaaaataaaagatcaaactatagaaggacaaggcatttaaaatgcagcaacagaactcaagagagaagctaacagcctacttccacctttccttgattttgattactttcattcttgaccctggagcctcagtcttgtcacctaatatctctgttaattcaaattccttttctcaattagcttctaagattattcaacagcaaggtatgaaattgattcttattgtattttccaaaaatcagggtcagataatgtcattataaaacatcacactgatttttaaaagaactgcaaaacagatttaagttctattatatgactaattctaattccgctatatgctttattttcttgccatatttaataactcagtactaaaaccctgtttaaattttttgtttctggcaagtaaatatcattaaaaaattatttgccatttatagtgatcccctgaagtgtgctttgcccaccaaagcttacttgctctacatggccccaggaaaaaaaaaaaaaaaacaaaaaaaacaatattatttcttcagggacagtgcctcagaagtattctctttttaccctcattgtcaagagaatggttacttaattaaaggtcagtgggtccatcttgaaaatatactagaaacagatttaatcatgttccctctccagactagatgttaatacctaagcataattaacaacaggatgccagtcaatgagtgtactttttacttcatatctggggagtttaggtgccttcaatttaataggggcctcggtgctagttaacaaattgacagtcttgacctgacttctaaaagtggctgtaaaacgatgcctagtcaattaagataaatgccaaattcctctgaggaaacaggcctaaatcattactttgaaatgggcatttcaggtatgaggccaggacttcacaataaggatataaatactagcttgggcatgagggaagatgtacacctagctattgtacacacaagataacagtgactcactttattcagcattatgcttggctggagattttaaattcctttttaaatacaagactattgtaccacagggtaaagattttattatcctcaataatgggattgaatatgccaaggcgatggaagcaggaaattagatctgctgatccccattgccaagacaggagttatcgaaatccacaacgggtcactttggtgagccttccaatgttgcagtggcctggaaacacagggactcgaagtagggaaatgtctggctccaactacgagaggtggtagaagtcatgctagatcaggttccaggcagcagaatggagtttagaacatgagcatttactgtacctctgctatttcagtattgctgaaatactaaaccaggaggcgaaggcactaagcagttacgcagcggggttactgatctggctctttcccacagatgccactatcaaatagcgcggagaagctagcagagtcgctgctgacgtattatatcactgcttgataagtcatgtatgaataaccaaattggtcaaacagatccctgaagacaaattgcaagtcataaaccttcaacctgaatcctaatttttatcaataaccaggagagttcatatttatcttattttttctgtattttcttcactgaaacttcttcactcctacttattttgcttccctctttctaagatttattgcttcctgccctgatatttggggagggaaaacagagggggctgtgatttagtttcctgtcaagactcaaatgaaatacactgcctctttatcactaaaaccctctagttggcaaattttaaatgaggtgacaggacattaactcagaaccctctgcccactatcttcctctgcactgacccctagccagacttgtggggacggaaagcaaaatgatgagtgtccagacatcttctcttctctggagcgttccaccaaccaaactgcaccaataactctaagctattaatgggaaaaatccccaagagacatatgcacaagtctaatcagcttttattctttttagagtcagggtcttgccctgttgcccaggctggagtgcagtggcacaatcatggctcactgcagcctccaactccgaggctcaagagatccacctgccttagcctcccaagtagctgggactacagatatgagccactattcctggctaagttgtttcattttctttctttttttttctttcttttttctttctttctttctttttttttttttttttgagagatgaggtctcgctacattgcccaggctggtatcaaactcctggtcttaagtcatcttccttcctcagtctcccaagttgctaggattacaggcatgagccaccatgactggctctactcagctttctataggcaaaagttcatctaagtgctgtttgtttggtggaacactccaaagaagagaactttcttaagccagagggaatatgaagatctttgcttctctagctgccctttcgttatccattaacatttacgattcataaaaacatgggtctatctccgcataggagaaatcattggcatttacatacccgtcaccactagggttgattacgtttcctttgacccagtagtccctcataatcaagttgatttccctcttaagagattagttctttaaacttctgctctggtctttttctgccctcttaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacagctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaacattgtagcaaccgcgacacaaaccattgagtacactactgcccagcaaaagtacttcagcaactacagtcctgtgattgggttttacatatatgagtctatagaatactggaacactagtgtccaagaagatgttctagaatacaccaaggggtttgtgcggatatcctggtttgagagctatttaaattaccttcggaaactcaatgtatccactggcttgcctaagaaaaatttcacagacatgttgaggaattcctttctgaaagcccctcaattttcacattttcaagaggacatcatcttctctaaaaaatacaatgatgaggtcgatgtagtggcctccagaatgtttttggtggccaagaccatggaaacaaacagagaagaactctatgatctcttggaaaccctgaggagactttctgtcacctccaaggtgaagttcatcgtcttcaatccgtcctttgtatacatggatcgatatgcctcctctctgggagcccccctgcacaactcctgcatcagtgctttgttcctgctcttcttctcggcattcctggtggcagattcactgattaacgtctggatcactctcacagttgtgtccgtggagtttggagtgataggtttcatgacattatggaaagtagaactggactgcatttctgtgctatgcttaatttatggaattaattacacaattgacaattgtgctccaatgttatccacatttgttctgggcaaggatttcacaagaactaaatgggtaaaaaatgccctggaagtgcatggggtagctattttacagagttacctctgctatattgttggtctgattcctcttgcagctgtgccttcaaatctgacctgtacactgttcaggtgcttgtttttaatagcatttgtcaccttctttcactgctttgccattttacctgtgatactgactttcctgccaccctctaagaaaaaaaggaaagagaagaaaaatcctgagaaccgggaggaaattgagtgtgtagaaatggtagatatcgatagtacccgtgtggttgaccaaattacaacagtgtgataatgtctgcttggcatattttcaccttaggtcttatcaagaccaaagagattatgttaatgaaacaattaaattcaaagttcttcccttttttaaagataggaaacaggcattgccaaaaaaaaaaaaaaaaaaaaaaggaaaggacagtggggagaaatgggcctggcatattttcagtctttaaaacaaaggagttgttatgagaattcacacacacatagacacacacacacacacacacacacacacacacacacacacaccctgggagacctatagtctcttaaactaagatcaagtagaagaaagcttattaacaagcaggatcctgccttatccaaactgcagatgttgctggcattgtgacaaaacccactgattgaaaggtcaactgccaaggcagaaacacctttaagcattgttcaaacaataaggcttccagaacttctgtagagcagtagctccagtcatggtctgtggtttgaggttttagctgtctcacctagctccctaacactgaaggagatacttgtgaaagttctgaccagcaaaagcaagccagagccttggaaactgatatgtggtagagtggccatcactcatggactaaaattgattcaccgctaaatttacccaggtgaagcagtttcgttgtctagaatgaaattatcatattccgccattggtatgcctttaacatttgtatagtttggtttgcttaaaacaccttaaaaccaatgacagctccagcactgcagaattggtgtgattctactttggaatagcttgtcacttgtcaccaaatgggtctgctttattagttacagctcttggcaggaggatccagggacccaaaaccacagggccaaacccaaatacctggcatgatggagcaaaagcaggtgtctacttggacccagatatagtgtctccattttaacaacaacaacaaaatagccagctggtacagctgtttgcattggccctacatgcattttttgcatggatatccagaaacatctgcccacacaaaactgcggggaaaaaaaatgaacactgaaatagttatttgctgttgcttccaacttgtagtgccagtctgcctttgctgtgaaacacacctgctcagagacagagaggggaagaagatctttggtaagtctaagtcctgacgctgagaagctttgtaaaagtgcagggagataaagggccaaaagggagatagatggaaaacactggaaaaagtattcactgatacaaatctatcaatgatggcagtccaattctcttgctaaagtggctgcacctcaccttgctggtcccccccacaccttttttgatgtccttctgcgtcatcatagcaaggcccttctgtaaattaacaagcctagatatttatactcttgacttccagtatctacagaagaatggttcatagatctaaacagaaatggtttagatctaaaaaggctgtatacgttgcccaggcccctgcatttctttaaatttataaaaatgaagctaaaacctggttacatttgaagcaaatatctacagtatttttcccttttagagatgtagcttccttagacatctgtagtggtaagcatttcccaaaagcatcttacctttctgaaccttagcagacatactgtgcagcttacctatcttctgcagaggaggaaactgagacctaggagaataaagtgactcactcaggtcacaccactaaagggttttcatcatttcagcatacctaagacagggcagtccaattttcagtattctcataagatggctattactcctctcaaaatgcatttccaaagtaggaacataggacttcgttggccacagggcagacatttttttagtgtctggaattaaaatgtttgaggtttaggtttgccattgtctttccaaaaggccaaataattcagatgtaaccacaccaagtgcaaacctgtgctttctatttcacgtactgttgtccatacagttctaaatacatgtgcaggggattgtagctaatgcattacacagtcgttcagtcttctctgcagacacactaagtgatcataccaacgtgttatacactcaactagaagataataagctttaatctgagggcaagtacagtcctgacaaaagggcaagtttgcataatagatcttcgatcaattctctctccaaggggcccgcaactaggctattattcataaaacacaactgaagaggggattggttttactgttaaatcatgtgttgctaaatcattttctgaacagtgtgttctaaatcagtcattgatttagtgtcagccacgtggagcacctcggcttaaagcagctccacaaaacctgacacaacacacacaccaattaaatggattttgttgagaatttaatcattcaatttggtcaaccagaatgacttcctgtggaactctgttttatgacagataatagttttccaacttgattgagtctctgtataccctgggatattgtattttttaatgaagggcattttcaaacttgtcaacttctcttttcagcacttgaaatgaaggcttatggaattctgactgtgaaatgaatttttctattgggagattatgcatgccaagatttattatttattgttagataattattatttatttgttaatactgattattgattattgctctgctgcattggtttagccccgctatggagaagacactttagaagtaactcagaatcacatccccataaaatctaagtctttacttcatcaagttttactttttgaattgctataaagacggaaaaattgatccctgcaaacacttgaagaagctgtgttttttttctttcaattaattccaaccaagacattaacgtccactttaccaaagaaacttacttggttggtttttagttggtgtttgttgtttgtttaccaaagaaaatattcgattcatcaaaaatattgctcctggtcaactaaaaaactgtgatactgggacttttttggccattcataaggaaaatttttaaaagtcaaggtaagggtgatattctctcatttagtggaagaagaagatgtcaattcacagggaatgtggtgttcgcaagaaagaaaatgatacttgaaatagggcattattgtttagcctacagcaacatttcaacaagcagcatcagggctcctcaggttaaaagaagtacagtttgtttcagagaaaaaggaagacaaaccctcgtgaaatgtttctccattgttccagctcataagttttactttgttttgggttttggagtttttagtttctttgatgtttgttttgctttaatttggtttgtggtttgtgtttgcttgtgtttgcttctgcctttcctaccttctgccttttactccctcagttttcagtcagaagtgtgataatcagatgccatcctccatggccacgcttatgtatgcaatataccgctccaaatgaggaccttggtaacccttgaccctttaattctaactaaccatcacccaatcgtaagtggcattatgggaccatgataccacttttctccagtgtcaatgacagagctcagctgtgtccatcacaagaaaaggtggaatgggcagctgtcttgggggtgtggcaagaggcagaacctcttggacacaaatgttatcttcctcataatggctttattcttttggatcctattaaagtacccctgtagcttatagtagtgtttgacctctgtgactctgttttctcatctgtaaaatggggataatatcagtaaatgtctttaaattcagcaaatacttatcgagtgccaaatatcgcccagatactgttcgagaggctggggacacaacagtcaacaaatcagattttttaaaatctgctcttgtagagtctacctttgagtgacattgcaggtatattgtggggattgaatgagatgagagatgacatttggaaagcactcttggaaaggcctggcaaagaaaagagactcaagacattatttgtaattcagcaatctcgcacagtagcattagggctcgggatgtaaagctactgagaagtagatttgagcctgagaattagggctacaaatacaatgagttgccacagaaggtagttaattaccagtcattttaggacatcaaaatgaagctgatcaccacatagtggggccactgtaaaggggctgcaagtcctggatgttggcatcatactatgatctttgaaaaaaacagatacaggcacttgcttttggggatggggaagggacaccactgattactgaataactgtggctggcttgtctgagggaatgtaaacattcccttgaggtaatttgcttttaattttgtgtaaaaagcaccaggtatttagagacataaagttcccgttttttaaaagaatagtaaatctgcaatacaaagaaaaatattaagttagtggattcgctggcaaagaactaagaatggctgcagccaacacactgcagagttcctccctgtggtggttacaactgttatttctgtttcatgccagtccaggagaaagcaaagaggaaagtggatgagctataatccgttcacctgaataggcagtgccaggatgtcccccccagcttgcctctcacccgccccgctgctgcccagctgatttgtttgaagtcctctttgatatctatgagagcaccgtggaaggaagaagaagggaggcgaccggagagctatggcctctgtgcagatttttgagttagattaaaattagtaccacctgattaggagcctacctggtgaggaaaaaagccttcttttcaaagtacaaaaaaaagcgatgtgtaccaaggagaaaaccagcagagaaagcttggtggaagaagtgatgttcttgtggaatgtgccagcagcttctccttccagaatgctgacaccagatgaatctttggttagaattaagcctacccctttgtttttcacatgagaaaactgaaccctcgagtaatgaaattatattcacagagctaattagaaacaggagactataattgaaatctagtttttagcctcaattctttctccattttgccactttactgccaaattctattcatctaaattattggggtcttaacctgggggccaaatgagttcatgggaggggtctctgagtttcctacaattaagttacatgcaaaaatgtgtgtatatgttcaacatgtgcattttcctaaactgagggctcagattccaaaagaggtctatgaccgaaaaagggtgaagaaccactgtcctaaattaatacagacctcattgggagtgtgatcctggtgtcctcattttggctaatgagcaatcaagaacttttgaactatcttttctctaaggatccaaaaatgcttcaaaatattggtttcttcatcccaagccaagtgcctacttctattcatttattcttcattcattctttcattcattcatttctttattctgcaaatgtattttcagtgccaattcatgttctagcagcagctaaatatgccctccacagcaggaccaggaaaggagccctctgtactgtgctcttgttggcaagaggaacaccaggttgctaccacattctcactgttgcaacaaattatatatagcctcaaattttcagtaaccatcccacacacacatacacacataaaggcagcagccaacaaagccaacatatagaagtgtgccctgtcaaagaaccaggaagagcagcctatttccaggttatatacagtgatatgctgtttacaactgcataccacatccttagaaggcctgctcccaaatgagccctactctgagatgtctacaccaggcatgctttcacacacgtgcagtaccctactctcaaaacaagtatggagagaataagtctcattcatctcgttaatatttttagtgggcaaagaagcaaccgtggccatggacagatgggtgcatttaaggacaggtgtggccgggcacagtggctcaagcctgtaatcccagcactttgggaggcggaggcgggcagatcacgaggttaagagattgagaccatcctggccagcatggtgaaaccccgcctctactaaaaaatacaaaaaaattagctgggcgtggtggcacgtgcctgtagtcccagctactcaggaggcaggagaatcccttgaacccgggaggtagaagttgcagtgagccgagatttcaccactgccctccagactggcaacagagtgagacttcgtctcaaaaaaataaaggacaagtgtgttttatacacaaatatgcagaagcccagttctcttgactccaagtcagaagctagataaaatagaggttgctgggggaagttggaaaataaatgactatactgtacttgttggctctgctgctgctgatataacttcaggcacaacggaagccgcctcggttggcctatgggaagggctgggtgaatcactgcttggccttgcatgaagcacaaaggacacaccaatggctgatcagtggcccttccatcatcttctgcccagccatgataaggaaagccttctattgagatggaggaatattagctcaactttgtagcatctgatgtaaagtttgaggggtttgtcttttttgtttgtttgtttgtttttttttgagatggagtctcactctgtcacccaggctggagtgcagtggcgccatctcagctcactgcaagctccacctcccaggttcacgacattctcctgcctcagcctcctgagtagctgggactacaggtgcccgccaccgcgcccggctaattgtgtgtgtgtgtgtgtgtgtgtgtgtgtgtgtgtttagtagagatggggtttcaccgtgttacccatgatagtctcgatctcctaacctcgtgatccacccgcctcggcctcccaaagtgctgggattacaggcgtgagccaccgtgcccggcaagggctttgttcattaggatcaacaaagtgctttgtctaattcctgcaaaatggcaaagacccagcccatttccattactcattccaggctcatgctcaggaaaactaataacgttctctttgacaaaacaatttccttaattttctaggatgaatcttgaacatgtttagctcagcctttcagatatttattctttaaattaccatcctgtcaaaattgcctttacgcactgatccagaatcaccaaggcagttgccacgatgcctcccaggactgtgggtgactgggcaaactggtaatgacccgttggctctgcttcacacacacacatacacattgacacacataaatgtacacatgcatatatgtgtgtacaacacaactataaaacatagaaacatatacctgtacatatgcacatgcttacatacacacatatcacagatgtgcatgcacacatacacatgcacaccaccttttacaatatgcctgacacatttgaggcacattaaaatgccttggcaggcccagccctatagttctgtaaggtttggcaggccaaaggcttcggatgtctgcaggataccattgaaaaaatgttatcttccccttctatatgtttcttatgcacgagcacagctaagagcagccaaatagtaagctttaaagaaaagaaacctggaaaagtgaatgtgccttgcaatttaaaaattgctaacagtttcacagtgggaaaattgcatttgttggaattttccaagtcataagcaagaagaatagcatagacccaaaacgacagagatctcttccaaggtatggaattgtggaaatttatttagaatatttgcttggtgatccagagaagggggaaagaagtggtgaggaagaatatatggggtgatccctccaaattgccaactcctcgtcttaggaagaagtgggcagtttccattgatccctagcatcagtttgacgggaaaaccggtgcatttcatcaacctcaaggaaaggaagtgccatgcatggaggcctggtgataggcaacatccatttagaagaacagtcacacaagcaacagaagaactatccaagactagaagcttagaagcttataccaaactctctgtctctctctctctctctcacacacacacacacagagtggatgggaggggacattaagaggaaccctagtgcagttcccccaaaaaaccttggcatagagtataacagggaaaaagtaattactgggaagctgaaaacaatcaaatatgtgaggaatgactgaatatgagctgaggataatgtaaattgttctggattgtctataagataaagatacagagcctgaatctatgtttttctgaataaagagaccccatattctcttttgaattattgacctataattcctcttcagcagctttgaatacactcaagttctcttcctattgtttatgatcccataatacaaccacccactatttgttgtggtttacaatccagcttagaacccttgagcaaaattattgaattattgaatgctaggcccaaacaaaagaaatttcagcttggttttagtaatttcttgatcaaacttctctcattcctctaaatgtacaaaggtttcaaagttgtaaaaaatatgtctacatagccaatgctcttagtatttttaacagcaaagataatctctgccaataattattaatgacaaaatagtgataactgttcaatgttgctttaacagtccaattgtagtaggtgagaaaacaaaaaagaagagaagctatgttgaatatttagtaatgttggaaaagatcctcaccctagacataaaatagtttaaacatttaaacatggcccctctcttattgtcattgctagtgaaagaagttcctgaaattgcatattacattgtaaagttttgggctaaatcacaatacatttttaagttgcttccatggcaatagatcgtaagaccacagcttgtcaaagtaaccactaattcagtattcagaaaccttatcatctgttcctccaaaaagaccccatagttaatgttgtgtttcccagtattttagttgggtttcttcacacttaggcaagtgggtgattctggtcataataaactattttcaaactaggaaaaagtatccaaatgctagagcacataatgagttcagcttggtcagttttgagacagataagcataaaaccctactagaaaaaaataatagtcaaacctaaagctttaaaaaatgtgagtcacatcacttttctccaggaaaggcagaacgtgctcagggtggaatttaatcaaaaatgtacccagaacaatttcccacaaagagctgtaatactttgcagcaaggggcattaataaactctaatttttaccgaaagtcaagagacacacagatcttttttggtaccctctacatcatcatagcaaggcccttctgaacattaacaagcctagatgtttctactgcttatttgcagtatctacaggggaatggttcgtggatataaacagaaatgttttatctgaagaggctgtgtatgccaccccagacccctgcatttcttaatatctataaaaatatgactaaacttgttacatttgaggcaaatatgtacagtatttttcccttttaaagatagtttaaaaaatcaaggtaataaaaaacggccaactctttcaggaaaaaaaaaatccggtattttgtactacttgagtttctctaatgcctaaaatatgcatttaaatcatcccacacctacacagaaacaaaatcagcagggaaaaccatcccactgatgattggcaattccaccgttcctctccatctgaccagctttcaccagagggcgatctttcatgcttgcacatcgagtttatacaatgtagaagcccccaagtcacctgggaaatggctcatgccaaatacatggagtccttagttgactatcttttcatattaaaatcccatcttccaatgaagcatcctgttttcaatactgatatcaaatttcgaatgtaaaggagatttcaaatgtattgctttcaccttttcttttttattcatttatttttaattgacataaaaattgtatatatttatgggatacaatgtgatgttttgatatatgtatgcattgtggaatgattaaatcaagctaattaaca

SEQ ID NO: 4429 - DNA, 47538 bp, human
gtctatgcagcaccaaaaaaggactcacctcccaaaaattccgtgaaggttgatgaggtaacatgttgttcatgttgcgatatattttgagtgtctgatttagttactgtaggataattttttacaaattgtatatcaggaagatgtgactgtttaaaatacatttatttatttatttatttatttatttatttatttattttgagacggagtttcgctcttgttgcccaggctggagtgcaatggtgcgatctcggctcattgcaacctcctcctcctggttcaagccattctcctgcctcagcctcccaagtagctgggattataggcatgtgccaccacgcctggctaattttgtatttttagtagagacaaggtttcaccatgttggccaggctagtctcgaactcccgacctcaggtgatccacctgcctcggcctcccaaagtgctgggattacaagcgtgagccaccacgcccagccagaagacatttaaacagagaaaatatatttccttatagtttgtttaatttgtgggaaatattaaactatggctttttcaacagataaactttaatgatacttaggtaagggcacaattaaggaatactttataaatgtttactggggaatccactgtgtcccaacaggttataagcacaactcacttttctaagtggtctgcctgattcttggcttatcttgattcttatcgagccaagaatatattcacattttttcctctctaagaaattagagatctggatcctttctgtttcttggctagaggagccgctcataagtatgtacttaataaatactaaatttaaaaaaaaaaaaaacaagaaatcttctctctactgtttacattcctttttggtctgtacttcccactaattattttggatattcagtttctgttgcctttgaataaagtgaggtaaggatctaccttcagtcctgggtagggttactagattggtgtttacataaagctaattagcttatcttttgccctttactcgcttctcaggccttggcacagtggcatttttgagggtaaagaaggcagccagcagtggctgtaagaagttctctgggtggagaataaacctgctgtcctgctttgattaacatcagaccaatcatttgaactgaatgacatgccctttggttactctcaagcttttttaaccccttcacccaccctttagagtaataaaatcttttttccaagctcaatctaaggtggaataccaaataccagtatataaaatggataaagaggagctgctttgtttgtagtcagtgggtggggagaaagtaggacacctcatagccctgcccttttggccttggcctcgttgattatggaaataaggtgcagagatagtttgagataaagttcaggttgcttgtaacccttagagtcactggaattcatgaagtattattattattatttttgagatggagtctcactcttgcctaggcttgagtgcactggcacaatcttggcttactgctacctccacctcccaggttcaagagattctcccgcctcagcctcccaagtagctgggattacaggcgcctaccgcgacacctggctaagttttgtatttttagtagagactgggtttcgccatgttggctaggctggtctcgaactcctgaccttaagtgatccgcctgccctggcttctcaaagtgctgggattacaagcgtgaaccaccacacccgaccacagagtcactgtaattcatgaattactagaaatattatattaaatacttacaaatttgataaatgtatcctgtagacagtacatcttttaaatctttgttttgttttaatgtgcgcagctttcactctactcagttcctgagggtcaatcgaagtatgtggaggaggcaaggagccagcttgaagaaagcatctcacagctccgacactattgcgagccatacacaacctggtgtcaggtacaactgttctgaaaatggagtgaacgcatttctgtttagagtccatagaggaaagtctgtattggctgcatgtttttggaaaaaggcatgataaagggccctgagatggttgacagaggctgggaagggtagtgggggtctgggggaaaggtggggatggctaatgggtgcaaaaaaaaaaaatagcaagtagcaagaatgaataaaacctatttgatagcacaacaggatgactgtagtcaacaataatttaattgtacattttaaaataacttaaagagtgtaattggattgtttttaacactaaggataaatgcttgagcggatagattccgcattctccatattgtgcttatttcacattgcatgcctgtgtcaacacatctcatgtgccccataaatgtatatacctactacgtacccacaaaaaatgttgaaatacaaggccccaagttaaaagtgcctgacttacagatgttcttcagtgccatctgaggaggggttgcagagatgccctagcttcctggtgacagctgttgccacagctacagagagaatttccctctccctgggcagtgcgtaacgccttaactagagagcagaggggctaggaactaccttgttgcttgcagttatgaaaacattgttgtctaccaggggaggcttgtgggctggaactctaaacaaaggaaaaagatgcaacgtaaacacttacataaaaattgcgaagtttttctccccccactatacaaatcagtgccacttaaaccaggaggggatatggcattttgaatgctatactaaaatagggtagaattccatactggattactgaactatttgttctagtgaccaaagaactacatatacagattggtttctgtccctgcctgggttttaggtcaggcatttgtcattacgtaaatgaaaagtatttctgtgatttttaacatcagtaaccaacgtttacaatctatagaatgcttttgtaggctttgatacatatgtttgttgtacttgatcttgattttgaaaattgaaattaataaaaactaatagatgtagatatgtgggaaattgtctagatttaccttgcttgagatttataaatttagtctttttgtttttttttttttttgagagggagtcttgctctgtcgcccaggctggagtgcagtagcgtgctctcagctcactgcaacctccacctcccgggttcaagcagttctcccgcctcagcctcccaagtagctgggattacaggcacgagctaccatgcctggctcatttttgtatttatcgtagaggcagagtttcgccatgttggccaggctgatgtcgaactcctgacctcaagtgatctgtccaccttggcctcccaaagtgctgggattacaggcgtgagccaccatgcctggcctaaattcaattttgatccagagcttgtttaaaaatttttaatttccgttgcctatgctgctgttgaacttttgttcaccaatttagaaagaaaatagtaaagcatggactctatcaacaataagaattaggccattatacttaagtatcataaccatattattgagttaagtaatacctaaagactttaaacataacatgttgtaaaatgattagactttattctcttgttctagaagatttttaaacttctggtagttaagataaagtcagcaaatttgtgtgtatatttttgtatcatgtaggcatgactactgttacttgtagtctgtctgttttttttgtttgtttgtttggtttttttggcaataaaagtactttgtaccttttagcctaaggttgctttttgttttttaccttttcttccatgcgtgatactcagtgcagcaaaatacctctctggatgatggattagttatctatatgtttatttccactactactaaatataaaaacttgcttgtaattataatagtttttgtaattataatggttttgttttcctgggtagaacaaagcctttatgagtagaaatatttctaattcctggttcctttttcagaccagcaatttctagcccttttcttgaagaaccaatttaattttgtttttttgttctttgtttttctttttttgagacggagtctcgctctgttgccaggctggagtgcagtggtgcagtctcagctcactgcaacctccgcctcccgggttcaggtgattctcctgcctcagcttcctgagtggctgggactacaggcgtgtgctaccaagcccagataatttttgtatttttagtagagacggggtttcaccatgttggccaggatggtcttgatctcttgaccttgtgatccgtccacctcggcctcccaaggtgctgggattacaggcatgacccactgtgcccggccttaattttttttaatagtaaaaatattaagctagcaaaagaagtcggcaatcattctagatattgatctgaagttttttcttttttttttttttttttggtagagacaaggtttcaccatgttgcccgggctgatctcgaactcctgggctcaagagatctgcccacctcagcctcccaagtagctcggacatcatacacataccaccatgcccaactaatatttttatttttatttttattttttttatttttttgagacggagtctcgctctgtcccccaggctggagtgcagtggcgcgatctcggctcaccgcaagcaccgcctctgggttcacgccattctcctgcctcagcctcccgagtagctgagactacaggtgcctgccaccacgcccggctaatttttttgtatttctagtagagaccaggtttcactgtgttagccaggatggtctcgatctcctgacttcgtgatccacctgccttggcctcccaaagtgctgggattacagccgtgagccaccgtgcccagcctaatatttttatttttttgtagagatggggtctctgctgtgttgcccaagctggttctcaaattcctgacctcacgagatactcctgtcttagcctcccaaagtgttgggattacaggcgtgaaataatggattttaatgaagcgatactcagttctttagatcttctggctaattcggcatttattatttcaggtcatttaaaagaatgaggatagcttgttctgacttgaactgaattacacaaaacaaatccttttccaggccgggcgcagtagctcacgcctgtaatcccagcagtttgggaggccaaggcaggtggatcacctgaggtcaggagtttgagaccagcctggccaacatagcgaaaccctgtccctaccaaaaatacaaaaattagttgggcgtggtggcgggcacctgtaatcccagctactcgggaggctgaggcaggagtaatcacttgaatccaggaggcggaggttgcagtgagccgaggtcgcgccactgcactccagcctgggcgacaaaagcgaaactctatctcaaaaaaaaaaaaattaattaataaaaataaaaataaaaaaaaaatcctttcccaaatggcaactagttttgataccttctgatacccatgtatctcttcttgtcttcactgtagacttcttgaaggtgggtaccttctagcgggtccctcgtttcctttaggatcatgtgatattcatgtacaaagccttttttttttttgagacacgcccaggctggagtgcagtggcgccatctcggctcactgcaacctccgcctcctggattgaagtgattctcctgcctcagcctcccgagtagctgggactacaggcgcgtgccaccacgcccggctaatttttgtatttttagtagagacagggtttcaccatgttggtcaggctggtctccaactcctgacctcaggtgatctgccccactcggcctcccaaagtgctgggattacaggagtgagccatcatgcctggccacaaagcctttttattgtttttaagagaatgttgacacctcatttgctttgggctatagcctttgtctcattaaagctggtcattcttgcttcaaatgggcagtttccagatgtaggctctaattaatggcagatcaggaagtagttaatatgaaagacaggtttaatctcatggagaaaagcttgccacttaaatatcaaggggattgatttttagtctattttttccattttaatggaagagtgaaatggctggattgttgaaaccactctgtttggaatctgcttcctgtggcagtagtaagccattctgctgagtaatttgcagtgaagggaagattataataggaaaaacaaacaaaaagacccagacagacagtgtatccctttgttcaaaaagcgttaataacatgataatttattcagtaaaaacaagtatatttattctgttaactttctaatcagcagatcctgtgaatagtttcattcagtttctttttacctttttaggaaacgtactcccaaactaagcccaagatgcaaagtttggttcaatgggggttaggtaagttgattttaaattaggcataatcagctacttcattaacattgaactctttaatcggagttccatgaatgagctccaagaaatctgtgtattccttaaaattatatgcagaattttagagctatgtggatttttctgggaagaggagctgttgttttcatcagatttcaggcaactagtgtccccaaatagtcaggtaagtctcttcaagatcgttaggattcttgggctagcaagtacagatacactgctttaaaaaaaagaaatctcatttctaggtgcagcgtaatacaccatactaattcatcaatagattttctgaatcggaatagctcatttgcattgcaattaatagatgctctagaagttttgaagcaggaaggagctgagttggtactcctataaaaggtcttactgcataattgatagtgttcttacttttttttcatttggttttattttccttgattatttttcagttgtgggccacttatcacatacactcacaaactggattcacagtccatgttctgactaatcttaatcagaaactggtaaattaataaagataccgatcatatttcattccccttattaggcatctcgcaaacaaaatcttgtttttacaagggtttgtttccatgatagaacaaaataaacataagtacagtttctttggtaagatcaccatggtgtattgatgtcctgatatttctgagactgtcagataaatttatcgtttgaagacaaacataacaatagctgcctactggttttttgtttttttttttttgagacaaaatatcactctgtcacccaggctagagtgcagtggcatagtctcagctcactgatacctttgtctctcaggttcaagcgattctcccaccttagcttcccgagtagctaggattacaagcgtgtgccaccacatccacctagtttttgtatttttagtagagacagggtttcaccttgttagccgggctggtctcaaactcctgacctcaagtgatctgcccgcctcggcccaaaatattgggattacaggcgtgagccaccgtacctggccccctactggttctttaaattattaaggcatgttaataagtaacatcttaattttattaatttcataaacacttatttaagacttatatgtcaggtactattctaagtgctttacaaataccaatttattgggggtggagtgaggatggttaatgagtacaaaaatatagttagaatgaataagacctagtatttgatagcacagtagggtgactgcagtcaataatactttattatacattttattttttattattttatttattttttatttttttgagacagattctcactctgttgcccaggctggagtgcagtggtgctatcttggctcactgcaacctctgcctcccaggttcaagcaattctcctgtctcagcctcccgagtagctaggactgcaggcacacgccaccacacccagcctattttttgtatttttagtagagacgggtttcaccatattggtcaggctggtgtagaactcctgacctcaggcgatccacccacctcagccccccaaagtgctgggattacaggtgtgagccaccgcgcctagcttattgtacattttaaataactaaaaaagctatactcttttaggtattgtaaataaactgaaagagtataattgggatgcttgtaacacaaagaaaaatgataaatgcttgaggtaaaggatacttcatttaccctgatgtgattattatgcattgtatgcctgaaccaaaatacctcatttaccccgtaaatatatacacctactatgtacccacaaaaattttatatatatatatatatatatataaattctcataacaagctgacagataccttattatcttcatttttatccgaggaaactagagaactcctgatatagtcttttatctgtccatgtgtggctgagaggtctcttgtttaaatttttctgagacaggatctttctctgtcatccaggctggaatccagtggcgtgatcatagctcactgcagcctcaacctcctgggctcaagcaatccttccagctcagcctcccgagtagctaggattacaggcatgtgccatcacattttttccactttttgtagaggcagggtctcacttttttgcccagactccgtacagtcttaaaacatatcttctttcccctttctttgtgatttacccactttggcccagctcaccagagccatctgggtgtccctctgtcaactgctctgtgtacacatctagaattgagcaacactgggctagtaggcaaaaataaagggaagtaaaaaattgcctcaaatgacccagactagaggatggaaagtaaaaactaggctaaaggcaaaataagtaacaggccagacagtaattaatgcaaacataatacaagtcctatagtagtatttaaaatgatcacatttcccaaagaacccaggaaaaggaaaactggcgtgtatctggtattacttaggggacagaattgctgagttttccagtttattagttcagttctgtatatattttttaagtcaccattctgccaggcctcgaaaattgagattggttaagacagtggtcacaaccactgagatgcgtgtaatatattattcagtactagtgcaaatacagagataatcacagaccattattgaaggtacagaggaaggagattagtttaattgaaatcgaggaggtgggagcagtcagggaaggacttctgaagtgaatcttgaaggagcagtgttagccactccaaaatgtgggggtgggactgctggaagcaggcattgcacactgggcccagcatgatcaggcttagaggtgtgacttggtattggatgtttgaggaaccctaagtagatagggagtgctgaagatgagattgagaaggagacatgagggctttgtgtaagtcatgacctagctaaaattcatttgttaattcatccagtatttttttttttttttttttgagacggagtcttgctctgtcgcacaggctggagtgcagtggcgcggtctcggctcactacaagctccgcctcctgggtttacgccattctcctgcctcagcctcccgagtagctgggactacaggcgcctgccaccacacctggctaattttttttttttttttggtatttttagtagagttggggtttcaccatgttagccaggatggaatacatccagtatttatcaactcctggcagtgtgatttttgtttttttgtttttttgttttttgagacagagtctcgctctgttgcccaggctggagtgcaatggtgtgatctcggctcactgcaacctctgcctcccaggttcaagcgattctcctgcctcagcctcctgagtagctgggattacaggcacacgccaccacgcctggctaatttttgtatttttagtagagacggggtttcaccatgttggtcaagctggtctcgaattcctgaccttgtgatctgcctgcatcggcctcccaaagtgctgggattacaggcgtgaaccactgcgcctggcctgtttttgtttttgtttggagacagggtctcattcagtcacctaggctggagtgtagtggcatgatcatagctcattgcagtcttgacttcctggactcaagcaatcctcccacctcagcctcccaagtagctgggaccacagacatgcatcaccacacctggctaatttttttttttaattttttgtagagacagggtttcgccatgttgcccaggctgttcttgaactcctggactcaagcaatcctcccaccttggcctcccaaagtgctgggattacaggcgtgaaccactacacccagccatcattcttaataaatatctattgaatgaacatccattattaccactgagggaagataacacagaagtgtaagcaatctatcattaaggagcttacattctccttggggagacaccagatatacacctgaataattaaacacagggtactataggattaggtaccaagtgatggtacagagaataaatatgatgggactttagaggagggagagaggtgtgaactgatgagcttaggaaaggcttttgtgtggaagtaggactcaacttggcttttatgaggtgggattggctcagtggagaggagacgaggcattatgtgaatgaagtcagaaggcatgttcagtcatgatgaataggtcacatgttgtatttatttttattctatcaccatcaacagcgatcaacagtggctattttctgagtgaaattacaagtttcctttattatccaaatttattctgttcttctgttcgagtaatgagttcagatggcaaaggatgcttatttttctgagtctaatgtatttgatttctttcttttttttttttttgagaaggagtctcgctctgtcacccatgctggagtgcagtggcgcgatcttggctcactgcaacctccacctctcgggttcaaatgattctcctgcctcagcctcctgagtagctgggattacaggagcgtgccaccacgcccagctaatttttttgtatttttagtagagatggggttttaccatgttggtcaggctggtctcgaactcctgacctcgtgatccgccctcctcggcctcccaaagtgctgggattacaggagtgagccaccgcacctggccttcctttttttttttttttttttttttttctttttaagaggctgtgtcttgctctgtggctcaggctgtcaggctgtcaggctggagtgcagtggctcaatcctagctcaccgcagccttgaactcctgggctcaaatgattcttctgccttagccttggaaagtgctgagtttataggaatgagccaccactcacagcttgtttttggttcctgagtttcagagagcaagcagcaaagcttcagatagcaatagatctatccaaagatttatccaaatctattctgtttttgtgtttccataacaagagtttgaatagcaaaggatccctgtatttgtattcctccctgtgcaaattgctgattcagatctgttgctttcaggaatatgaaagtaatttaacatttacttcattgtcagtaggttgttggaccaaaggtacttgaaaattggacacttgcagccgggcgcagtggctcacacctgtaatcccagcactttgggaggctaaggcgggtagatcacctgaggtcaggagttcgagaccagcctggccaacatggtgaaaccccatctctactaaaaatacaaaagttagctgggcgtggtggcgggcgcttgtaatcccagctacttgggaggctgaggcaggagaattgcttgaacctgggaggcagaggttgcagtgagccgagatcacgccattgcacaccagcctgggcgacaagagcaaaacttcatctcaaaaaaaaaaaaaaagaaagaaaagaaaattggacacttgctatgtgaatagtaaatcttgtttatatgtcacataaaaagagtatgttgaagagaagtatagtagcaggatgcagagaatatgtggtttgaaaagcacttgatactatatatacatattatatactgtataagacttttgttttgttttttaatgagaaatttatggaactgcttcctggtctaattctattgtagacagctatgactatctccaaaatgcacctcctggattttttccgagacttggtgttattggttttgctggccttattggactccttttggctagaggtaggtgcaattttatggctttaacagtcagctcataaagcagagatagaatatatgtttcattctttcccttcatttaccaggtttcagaataatgagttggttcctaaatacggctttcttaatgtataatggatatggttatcatatttgattttaaacataaatagaaattgtatactcttggtaaaaaaaagaagttatcctttataggcacatttacttgatcaaatctctgttgttctttggtacagaaagagcaaaattttaaagtctttcacacctgagaaatcaactgtttctaaacgtttcactattaagatcaagctatattaatcacagtagatagagcagtgatttaatagagattttattaccttcttgatttgtcatgccttcagtcagtgatgacaaaaactttaaaaatgctttaaatactaacaaatgccaacttaaaaatattactatactgctagattataaaatatctataggaaataaaggctaataaaatactttgctatgatgagatgaatttgttatcaactacttgaagttttgctagttggaaactaaatgtttatgatataaaattctgacattaccatcattcctaatgaagaaagtttatgaatcctgtaatcagacccctgtaaaagagaaccatagagactactctggtccctgtattagtttgttttgcattgctataaaggaatatctgaggctgggtaattataaagaaaagagatgccaggcgcagtggctcacgcctgtaatcccagcactttgggaggccgaggcaggtggatcacaaggtcaggagatcgagaccatcctggctaacacggtgaaaccccgtctctactaaaaatgcaaaaaattagccgggtgtggtggcaggtgtctgtagtcccagctactcgggaggctgaggcaggagaacggtgtgaacctgggagacggggcttgcagtgagctgagttcgagccactgcacttcagcctgggcgacagtgcgagactccgtctcaaaagaaaaaaaaaagaggtttatttggcttatggttctgcaagctgtacaagaagcgtggcatcagcatctatttctgttgagggtttcagaaagcttccaatcgtggtggaaggcaaagggggagcaggcgcatcacatggtgagagagggagctagagagatgccaggctcttttaaacaaccagccctcatgttaactaatagagtgagaaatcactcattcccacagggagggcaccaagccattcatgagggatccacccccatgacccaaacacctcccagcgtgggggttcacatttcaacatgagatttaaaggggacaatcattcaaactgtatcagtcctattcctccaatttaaaaaatcttccctctacatgcaatagcttttactttagtttagtttagtttcgtttcgtttcgtttcgtttcgtttcgtttcgtttagcttaatttgagatagagtctcactctgtcgcccaggctggagtgcagtggcacaatctcggctcactgcaccctccgcctcctgggttcaagtgattctcctgcctcagcctcccaaatagctgggattatagatgtgcaccaccacgcccaactaatttttgtatttttagtagagatggggtttcgccatgttagccaggctggtctccagctcctgacctcaagtgatcggcctgcctcggtgtcccaaagtgctgggattacaggtgtgagccactacacctggccttattttttttttaattgatttcttttttgagacagggtctcactctgtcacccaggctggagtgaagtggtgtgatcatagctcattgcagcctggacctcctgggctcaagtgatcctctcaccttagcctttcaagtagctgggattacaggcgcctgccaccatgcccaggtaatttttgtatttttagtagagacggagtttcgctatgttgctcaggctgaactcctgaactcttgaactcttgaactcctgaactcaagccatccacctcccttggtgtcccccaaagtgctgggattataggcatgagctgccgcacccagctaatggctgttatttttgaatctggagggtagacactgccctggtggcactaccagctcacctgtggaagcaactcatgtcacagtctttgtgccctcctcccatctcatgcagaatatgtcagaattaaatttccagcttatttttgtaatcaacttatgaaccaacatttttccctaaacttctttcacctcatttcttgcaaagctgttcagaagagcattcggtcttatttagatagcgtttgagattgatgaacatcccaaggccagggtgttgggatttcagctatcgttagggagataggaatgtagaagtgagtgagaggagcttccccctccctctcctggttagagcatgtgggaaaatcttccaggtccaaagaaagcactttttctgtgctgtgggtacgttcctacagtgccgagagcttgtccctggaacatccactaggatgaccatcctaaggaggattggagatggtgctctcctggccagagcagcagcatgaggacatctgctacagtgggtcctagtcctctgattttgtttgttcgttctgtctcttttcttccttttcctggggagagcttggtagtattaaaataatttgacaccttaattctttttcacaaatattcacacaggcacgcacacacacatgtgcaatagcaggtcttttctcctgagcgttgggtatagaaagacctgaggtgagcagcatcagaggggttcaccaagcaagatgagtggggtgatagggatgtctgtgggtagccagaatggtttgcaggcccctccaggtgaatgggcccctttgagggcagcagcagggtgggtgggtgcagaaggtccctcctgataggagtttcttttttttttttttgagacagtcttgctctgttgccgagactggagtgcagtggcgccatctcagcctcactgcaaccctgcctcctgggttcgggtgattctcctgcctcagcctcccgagtagctgggactacaggcgtgcaccaccatgcccagctcatttttgtatttttagtagacacgaggtttcaccatgttgaccaggcttgtctcgaactcctgacctcaagtgatcctcccacctcagcctcccaaagtgctgggatcatagttgtgagccactgtgcctggcctggtggggtttcttgagcgtatctgctaaggtagtctgcttcagttgttgaggattgccacaactgtggtggtgacaagaggctctcagagaggtgaatggatgtccattcagaggaagtgggcccagccagaccactccaagatgacacgtggttgttgacactattgttgccttctggtggctctccccagcattggccaccagtggttccccccgcccctggcagtgctgatagtgacaacctgtaccactggcctcttgggagatagggcatggaggtgggggcaggggagtatgattacacctccttcctgaagttcttgggtctctggctcattgtgtgaaccagcaggagctggaggcccgagagctgccacttctcggctctccctggaggagtgagaaatgactgggtggcaggttggctgctctttccctggtcctcacttgggtgagctgcttcaagtggatgggggcaggggaggggccatatgcagggatatcacaggcttttctcttctaggataattataccctttcaattcatgcaacaggatcaggagagaaacagtaaatcattaatagtctaggttgataacatttgtattctcttcagcagtcccagttccatcgttggggatttctctgtttaaagttttaaagccaataaacagtacttatgtgattagaaccgtttaaggattaatgtacacattctgtcggggtacagtggctcacacctgtaatcccagcacttcagaagttcaaggcggatgtatcacctgaggtcaggagttcaagactagcctagccaacatggtgaaacccgtctctactaaaaatacaaacattagccaggcgtggtggcgggtgcctgtaatcccagctacttgggaggcgaaagcaggagaatcacttgaacccgggaggcagaggttgcagcaagccgagatcgcaccactgcactccagcctgagcaacagagcgagaccccatctcaaaacaaacaaacaaacaaacaaatcagccgggtatggtggctaacacctgtaatcccagcactttgggaggctgaggtgggtggatcacctgaggtcaggagttcgagaccagactgaccaacatagtgaaaccctgtctctactaaaaatacaaaattatttgggcatggtggcgcatacctgtaatcccagattcttgggaggctgaggcaggagaatcacttgaacccaagaggtggagattgcagtgagccgagattgcaccattgcactccagcctgggcagcaagagcaaaactccatctcaaaaaaaaaaaaaaaaatcaataacacacacattctgctagcatctatatgggtcccacagcaaaaaacactatgcctctcagtggagtcaaggccatgtgtattctctagtttcatcctctactggtttttttaacctcattctcaggtttctccaggctctgtgtcctgctgtctcttctgtccatttcccttgctccacagctctatatcctcctacaatctggcctgagacttcaacacagttcttgttttgggactggtcttcttcacactttcttgggtttaagcccccttttcctgggttccatgtcatcttctccttggtttactctgccgtgctgttgaactacatgcttaagtcactttcaaaaaagcgtatgttggaggtaaacttcccaagaccttccatgtctgaaaatcactttctgccctcataccatgtgacagtttggttgggcactgaattttgtttgccatcaaaactttcaaagccatgtattctagcatctggcgttgtagatgtgagagtcagtagccattctggatatttgctgcttctgaacaggtgatacattttttttttcttcctggaagctttgaagatcttctgtgaatctttagtgttctgaatttctttggtgctgtgactagatagaagtcttttctttttttttgagacggagtctcactctgtcacccaggctggagtgcagtgtcacaatctccgctcactgcaacctcctccacctctgggttcaagtgattctcacgcctcaacctcccagttagctgggattacaggcgtgcaccaccacgcctggctaatttttgtggttttagtagagatggggtttcaccatgttggccaggctggtcttgaactcctgacctccagtgatccacccgcctcagcctcccaaagtgctgggattacaggcatgagccaccatgcccagccttggatatagtgttttcattcttgcccaaacaatatggcggcttgcagcatccagctgaaggaaaatatcttcttttcctccctccctccctccttctcccttccctgccctcccctccctctctccccttccctccttctccctccccttccctcctccctccccttccatcccctgcatccctccctcccctccctccttctcccttcccttccctccttcttccttcccttctcgtcccgtccctttctcttctcttctcttctcttttctttctgagagatgatctcactctgtcacccaggttgtagtgcagtggcatgatcagggctcactgcagtcttgacctcctcaggctcaagcaatcctcccatctcagcctcctgagtagctgcgactataggcatgcaccaccacacctgactaatttttttttttgtggagaccgggtgtcaccatgttgcccaggctggtctcaaactcccgagctcaagcagtcttccttcttcagcctcccaaagcgctaggattataggcatgagccactgcgcccagcctatcttgtgtatctttgaaaatttactctcattctttttccttcctcaacgcattaattagcaattgagttatttaaaaggaccctatgtgtctcttatattttcttgattattttattttgttccttttgaattttttttgctttggtcatttccaagagctccttcctgttctttgaatgttctttttttcatagaattatttttttcttttaatgtagtggcttttaaaatttatttgatgatacttagtaataggtttagttttgttttgaagttcttctgtttcctttgtgcttgtcttggtctttctcctttatgtttcaggctttccacaaatgactggtgattcttggttatccagtcatgtttcaaagtgaggcagctgaaatgctaataagaactctttcacctgtaatcccagcactttgggaggctgaggcaggcggatcacctgaggtcaggagttcaagaccagcctggccaacatgggaaaaccccatctctactaaaaatacaaaaaatagccgggtgtggtggagggtgtctgtaatcctagctactcaggaggctgaggctagagaatcacttgaacccaggaggcagaggttgcagtgagctgagatcacgccactgcactccaacctgagcaacagagcaagactccgtctcgggaaaaaaaaaaaaaaaaaaaaaagaactccctgtctgtacatggggcccactgacgggcaggttctacctcaggggagctgggcaggaagtgaccatatacaagggtgcacccagggccagtgtgaggagggcttttctctcaggcactgacatactcaccccttccagctctcttggttctcagcaggaaatccatggtgtttctttagtgataccctgcccccactgttttaactcttttttttttttttttttttttgagacaggatcttgctttatcacccaatgtgttaggccattcttgcattgctataacctaacactgggtaatttataaagaaaagaggtttagttggctcacagttctgcaggctgtacaggaagcatggcaccagcatctcctcggcttctggtgaggccttgggctgcttgcaatcatggtggaaggcaaagggggagctggtgtctcacatggcaagagtgcgagcaagagaaagaggtgggggaggtgtcacacatttttaaacaaccagatctcaagagaactcactgttgcacaaggacagcaccaagggaatggtgttaaaccatctgtgagaaatccaccttcatgatcaggtcacgtcccaccaggccccacctccaacattggggattacaatttaacatgagattcagagagaacaacatccaaattatcacccaggctggagtgcagtggcatagacacagctcacagtagccttgaactcctgggctcaagcaatcctccagcctcagcctcctgagtagctaggaccacaggcacatgccaccacaccttactaattttttaattttttgtagagatgtggtctccctaagttgcccaggctggtctcaaactcctgggctcaatcagtcctcccacctcagcctcccaaagtgctgggattacaggtgtgagccactgcatcaggctcattttttttttttttttaaaggaatagagatggggggctgggcgtactggctcatgcctgtgatcccagcactttgggaggctgaggcaggtggattgcttgagctcaggagttcaagaccaacctgggcaacatgaggaaaccccgtgtctacaaaaactacagaaaaaaaaaaaattagccaggcatgatggcttgcacctcttgtcccacctacttgaggggctgaggcaggaagatagtttgaacctgggaggtcgaggctgcagtgagccatgattgtgccactgcactccagcctgggagaccgagtgaggccctctctcaacagaaaaaaaagaaatggagatggagtctcgctatgttactccagctggtctcaattcctggcctcaagcaatccttatgcctcgacctccccaagtgctaggattacaggtgtgagccaccacacccagtaaccctggtttactgggttttttaacattttgaactggtgtgacttcctggccaggggtagttttgtactgggatggcataggggaaggaaaggccatgctggtccatgcatcggacttgcgtttgtcctgtgcccttgtcttgctccctggttgccatctccactccccatggtacctgccatctctggatctggaatctccctggggctgcctgggacagatctgctccctctgaggctgcactcctcctcaagatttcaagatttcaaggcagtgtgtcctcttatttccgttcactctccattttctgaaaattgattgacacttcctttctgccagtggcccttccacacattttctcttcattgtgggtttattaatgttttttcttactgtttttttaacggggttgcagaaaggggagaagaagaacgcttgtgtttagtatttatataggaagccagattgctataaaagaacataaaccctagaaaccaaaatactcatttgtttatttttaaaataatctttttttctgctctcttagggaaaaaaaggtgttcttttgaaaacacttggtgctgagtgaaagaagccagtcacaaaggaccgtatatttactgcatgattccatttatatgaaatacccagagggccgggcgcagcggcttacacctgtaatcccagcactttgggaggccgtggcgggtggatcacctgaggtcaggagttcgagaccagcctggccagcatggcgaaaccccatgcctactaaaaatacaaaattagccgggcatggtggcgtgtgcctgtaaccccagctactcgagaggctgaggcaagagaattgcctgaacccgagaggcagaggttgcagtgagccaagattgcgccattgcactccagcctgggtgacaagagcaaaactctgtctcaaaaaaaaaaaaaagaaatatccagagtaggcaaacacatagagatagaaagtagatcaatggttgcctagggctggacggtacgggggagttgaggaatgactgctaatgggtttcttttagtgattatgaaaaagctctaaagttaattgtaatgatggttacacacctctgtcaatatactaaaagccattgaactgtactttaaatgggtgaatatgaattttatctcaataaagcagtgcaaaagcgttttggtgcacatgactttatttggcacattctttcagtttaggaccaaagaaatcttattcagtggtggggttattttggttttgttgtttgggtttcttaagagacacggtcttgctctgtcacccaggctggagtttagaggtgtgatcatagctcattgtaacctcgaactcctgggatcaaggaatcctcccacctcagcctcccaagtagctaggactataggcacacactaccacgcctggctaatttttttattttaatctttgtagagacaggatctgactatgttgcccaggctggtgtcaaactcctggcctcaagtgatcctcccgcctcggcctcccagagcttttggattataggcgtgagccactgtgcctggccttgttccgtattaaatggataaggtaaattgtgatggtgaggataatgaatcatctgatggcgtgtacaaccttttatttatcaggttcaaaaataaagaagctagtgtatccgcctggtttcatgggattagctgcctccctctattatccacaacaagccatcgtgtttgcccaggtaagagaaactctgtaatccatgatgtccctcattcttgtttgtgtgtgtatgaatctgatgcttaattttattttattttgcagttcttataacaccagactaaaatttgtttgtacatatagatgaatacagaaaatttaaatgattttctccactatatgcctcagttctggcccttcttccagtaatgccagtgttcacagaatttgaacacgaatttgcgtgattgtttgaatgttcatcagcaaaaatttaatatacattttttgtatacttacatggaagtctagagactcaaattccaaagctgataattatgggtcactcagtttatgcatgtccggtcacaacctgctctcgttggtattgtagacccagactactctgacttccactcctccctagtactggtgcccttgctttccttgctggggactttggggactgtaatcccctctgcttggagtgcccttttcggggctttcagttggctgctcctttcttatccttgaagcctcagtcttatggtaccctggcaagcaggtctatcacggtggcaggcaacatggataaagctgtaccaccgattcttaaaatgtgttaccagaccagaagcagcagcatcacctgagaacttgttagaaatgcaaactctcaggccccaccccagactgactgaatcagaagctctgggagtaagggccagcagtctgtgttttagcaagccctccggtggtttgttattaatgcctatggtgtttgagaaccactgatggagaccagtaggtagcctgaaaagggtgatatctggagtgagtgggactctagagatggtgtccctcaggaactggtaagaacaagacaggctctaggttttgaggtcctgggcagattgtggacacagggactttagctgctggaactaccacatcacatggaaactcagttccaggagcagacagcagtgcagtcacccaaattggactctgagccagactgacctgagactgagcttccttggttgttcatgacagtattgaatccagattccttgattgggctacagttgtatgtgagagtccagtggccccagcttggggagcttgatggctttgatgacaaataccagtactttccagcatttgctcaacattgtttgtaacagtcctggaggcagatagttaatgcttctgtccctgctccagccccaggtcaggaacagtgagtaacatcttccagccctagatataaaaataattaaacattatttcagcctgttatggtttaagcagtaaatagctagagtggagagggtgaacttggttgctcgttgagaagcatatgtggctgtccccagagtaggagtcttttttttttttttttaaatttctttcttttttaacttttagcgttaggtgtacatgtgcaggtttgttattgtaaatcgtgtgtcatgagggtttggtgtacagattattttgttacccgggtaataagcctagtacctgatgggtagttttttgatcctcgccctcttctcaccctccaccctcaagtaggcctcggtctctgttcccttctttgtgtccatgtgttgtcaaggtttagttcccaattacaagtaagaacatgtggtatttggttttctgttcctatgttagttcacttaagataatggcccccagctccatccctgtccctgcaaaggacatgagctcattctttttggctgcatagtattctgtggtgtataagtaccacattttctttatcaagtctaccattggctgggcatgttggcccacgcctgtaatcccagcactttggaaggccgaggtaggtggatcacctgaggccaggagttcgagaccagcctgaccaatgtggtgaaaccctgtctctactaaatacaaaaaattagctgggtgtggtggcacatgcctgtaatcccaactacttgggaggctgaggcaagaaaattgcttgaacccaggaggcagaggttgcagtgagccaagattgcgccattccactccagcctgggcaacaagagcgaaaactccatctcaaaaaaaaaaaaaaaatctaccattgatgggcatttaggttgattccatgttttgctattatgcatagtgctatgatgaacatatgcatgcatatatctttatagtaaaatgatttatattccattattattcccaataatagggattgctgggtcagatggtaagatcttttctattttgttttaaggtcagtggggagagattatatgactggggtttacgaggatatatagtcatagaagatttgtggaaggagaactttcaaaaggtgaggagcatctttttcattatcttccttttggtttaaatatgtggtttctctagggttttgtaaaatatttgataaccctgttgatttattgctttttctgtttgcttctagttctgtctccagctcagatttttcaggtgacctttcttggtagagcagtagaacttctgagtatttggttattatcagcagggccaaataagtggtgaccataaaatgcaatgcattccaccgtagtcttagaccatattttccattatattgtattcctagtttcctctaagtgtagcgtattatttaaaagtcttattgaaactgaattcaaagggaatgtactatgctcccaggaaaaagacataattgagagcctcttcctcttggtttttcacttatcatgagttctgttctttccttagcactgctgtttctgtttatcccccaggcttctcagctcagctgagggtgtgagccatcgtatgttggggactagctaccagctaaaggccacgttctctgtgctgtctagtacatgagcaacagagggaagaagttgtgtaattgtaagaacttgtcacctttcatctcttttagtggccacatagccgattaaatgttgcctatgttcgcttggaacattcccttcctcccactgataaggaagaatgagtagagaataaggtatcatgtctctactaagcactcagaggcacagccagctaaggaagaattagacttcttatattaatataccttctacatcacagattgaaggaagttcatttttcaatgaaaatactttttaaaaaaaaataaataactgagcttcaaatcattgacaagttaaaaaaatacatataaataactatctcagaattaaaatccagaattttgaactgggatttggaagtaacagaataaattataagccctctttattatttacataaataatcttctagtgaaatcttaagactcattttttggccaggtgcagtgactcacgcccagcacattgggagtccaaggtgggaggatcacttgagctcaggagtttgagaccagcctaggcaacatagtgagaccctatctctccaaaaaataaaaaatttagctgggcatggtggcatactttgggaggctgaggtgggaggattgcttgagcccagaaggtaagggctaaatagagtgagccatgattgcgccactgcactccagcttgagcaacacagtgaggccctgtctcaaaaaaaaaaaaaaagaaaaaaagaaaaaaaaccccactaatttttatactggtggtttctaaaggaattagtccttctcgagcctatttaaactagctcttgaataggaaattctataccaatatcaagagtcttttggcaatccctgtttttttgattgttttttgttttatttctctgatattttctatggaagcttcctttcctttttaaaaaattccttaacaaatgcggccaggtgcggtggctcatgcctgtaatcccagcactttgggaggccgaggcgggtggagcacctgaggtcgggagttccagaccagcctggccaacatgatgaaaccctgtctctactaaaaaaatacaaaaattagctgggcatggtgatgcacgtctgtaatcccggctactcaggaggctgaggcaggagaattgcttgaacccaggaggcagaggttgcagtcagccaagattgcgccactgtactctagcctgggcaacagagcgagacttcatctcaaaaaaacaaaaacaaacaagcaaaaaaacaaatgcacactaaattttatatgggaaaggaagtaaaatatcaagaaatctctaaacagccctagacagaaatgtggaaagtgagactaaaagcctcaactgcgagccttcattgtggtgtgactgcagactgaagcacaccaaagccagagggagtcccccaggctccccggagtgctcactgtggtgtctgtgcagacacacacgcacaccaaagctaaagtgagggctgcgggagcctctggcttggaaacagcattctctgactgtgctaagaattcagcccagtgcagaagcagctggactgtggttaggataccagttaagcaggccaacattttctggtcatttgaagacattagatattaaagctacccaaatttatatgcagatctttttagagtgaggtggtaaagatttttaattagctcatgattggtttgcatttctctctgtctttatacccttgccttcttcagagtcattgagaacttaaggctttctcctgtttgttactctccaaggataattttattgacagctgtctgttctcaatagaaggtaataaaatcagggccaggcacagtggctcatgcctgaaatcccagcactttgggaggctgaggcaggcaaatcgctttgagcctaggtgttcgagaccagcttgggcaatatggcaaaaccctgtctctacaaaaactaccaaaaaaaaaataataaccaggtgtggtggcatgcacctgtagtcccatctacttgggaggctgaggcaggagaatctcatgagcccaggaggtagagtttgtggtgagccatgttcaccccactgcactccagcctggtgaatgggagtgaaaccctgtatcaaaaacaaacaaacaaacaaacaaaaaaaaaaaacggtcgggctcggtggctcatgcctgtaatcctagaattttgggaggccgaggtgggcggatcacgaggtcaggagatcgagaccatcctagctaacacggtgaaacctcatctctactaaaaatacaaaaaattaatgttgactgcattaaatatttattacaagttttaaaggaaaaatagcagaaggccctattaattcaaaattcaatattcttaaatttcaggaattacttgatataatgaagtggcattgttttttgttgatcttgcttcaccccccccactttagatttcatgggcttcagggggatttttgttttttattttttggtttatttatttatttttgagatggaatcttgctctgttgcccaggctggagtgcagtggcacgatctcggcttactgcaacctccacctcccgggttcaagccattctcctgtctcaacctcctgagtagctgggactacaggcgcacaccacaacacccagctaatttttgtatttttagtagagacgggttttcaccatgttggtcaggctggcctcgaactcctgaactcaggtgctccacccatctcggcctcccaaagtgctgggattacaggcgtgagccaccacgcccggccttgtttttgtttttttaatgagagctaagatttaagctaccctggaaaatgaatctttctggggccttggagctgagtatattctcttcatagactatcaaataattcaaaatctagtaaaggagataaggaaagcatatgaccaaaatacaagataaaatgtgataaatgccagaagaaaggcacacacaaaaatgtatgatttttggatgaagatatcttgtcttcattgaagggaattaagggacgcttcatgaaggggacttttttgtttcttagcttgttaggaagttggttttcaagtccagctttaattaccagtctcaattaagtatcatctaattcatattttttttttttttgagacagagtctcgctctgtggcccaggctggagcgcagtggcacgatctcggctcactgcaacctccgcctcccgggttcaagcgattctcctgcctcagcctcacgagtagctgggattacaggtacatagtaccacgcctggctaatttttaatagagacggggtttagtatttttagtagagatggggtttcaccatgttgtgcagggtggtcttgatctcctgacctcgtgatctgcccgcctcggcctcccaaagtgctgggattacaggcttgagccaccgtgcccggccaattgtttgtattctaatcatgtaacagatgtactggcttttggttgtacatagtcagagaaactgtggacactatgtttaaaacagggtgctggccaggtgtggtggctcacgcctgtaatcccagcactttgggatgtggagacgggtggatcacttgagcccagaagtttgagaccagcctggacaacatggcgcacccccgtctctactgaaaacacaaaaattagccaggcatggtggcacacacctgtaatcccacctacttgggaggcggaggcacaagaatcacttgaacctgagaggcggaggttacagtgagctgagatcgtgccactgcactccagcctgggcgaaagagcgagactcggtctctaaatacatacatacatacataaaacagggcactgaaaatttttaaattaggaatgatggcacaattcttaacggtattatttcccatgggggtatattactctgaaatatcccaaacaggtctgtggcattttgctgctctgccacatcccttttccctcttacgaaatgattctaaatgtttgtgctgagtcttctaccaataaagtagtgtttcagtctgtcatcattggttacttaagaggaatttatctgcttcagttaaaatgaactttttgtcagaactatgaagcaaagataggtgtgtccagaaatattgtcatcttggtacagtctagggctttcttttaagttacaagaatatataacatatgtatagtttaaaatccaacactataatgaccatgtacataccaaccaattatctacctttaaaactaggaaattaccgtggggcgcggtggctcacgcctgtaatcccagcactgtgggaggccgaggcaggtggatgacgaggtcaggagttcaagaccagcctggccaagatggtgaaaacccgtctctactaaaaataccaaaaaattagccaggcatggtggcaggtgcctgtaatcccagctactcgggaggctgaggcagagaattgcttgaacctgggaggtggaggttacagtgagccaagatcgcgccactgcactccagcctgcgcgacagaacaagactccatctcaaaaaaaaaaaaggaaattaccgatgcctttcaagtcttccatgggtcccctcacccccaagtctccccagagggaaccattatctggaattttatttcattcccttgtttttctttaaacttttcttccagtttaaccatatatgtctgtattctgaaatactattgttgagcctgcctgtttttgcctttataaaaatataccaaatttaagtctaaatatacatattatatatatataagtttatctagatgagtcttactacatattattttgcaacttgttttgttcccttaacattttgtttatgggttatgtatggcagtagtgtattcatcttcactgctgtagactattttctttgtgttgttgttgttgttttaatagacggagtctcactctgttgctcaggctggagtgtagtggtgcagtcatgactcactgcaacttccgcctgctgggttcaagcaattctcctgcctcagcctccagagtagctaggactacaggcatgcgccaccatccctggctaatttttgtatttttagtagagacagggtttcaccatgttggtcaggctggtctcaaactcctgacctcaggtgatccgccctcctcagcctcccaaagtgttgggattacaggcatgagccactgcgcctggtcatattttctttatgggaaaatacccatgttggtggctccttgggtgggtttcagtatattactattacaacacagcatggcttcataatttgtgaagaatttttctagaccagggttcctgattcatagggtctgcatatcttcagttttactagatgatgccaagtaattgttaccatttttgccagtgtgatggctttaaaagagtttttcatcatggagtatatgtgtatgtggctttactttatttcccaattttcattttgagaaaatttcaaaactacagatcaggtgcaggactagtacaatgaatatacccttcacttagattcactaacatttgctgcatttgcataatctatcttttcacctatgcatggtgttcatacacacgagtatattttattttcctgaaccatttgagaattaattgtagatatcattgcattttccatctgtatctaattcagcatgtatttccaaagaacgtggacattcatttatatgatcacaataccgttattgtactcaggaaagttggcatttcattatttacacaaatgttatctaatatatagcccatgttcaaatttccctagttgccccaataatgtacttgccttaaacaacttttgattttttttttttttttcgagatggagtgttactctgtcgcccaggctggagtgcagtggcgtgatgttggctcactgcaacctctgccttctgggttcaagcaattttcctgcctcagcctcgcgagtagctgggactgcaggcgcacgccaccgcccccgcctaatttttgtatttttagtagagatggggtttcaccatattggacaagctggtctcaaactcctgacctcaggcagtccacctgcctcggcctcccaaagtgctgagattacaggtgtgagccaccatgcccgaacttttttttttttttttttttttttttaagtctctcttaatctacaggctccccttccatcttttggagttgacttccttacagtttatctgttaaaacagtctggcacatttcacctatagagtttccaacggtttgggttttgctgattacacatttatgctatagtttaacgtgttctctgtactccctgcacattggcagctggatgcacgggctacttgaaccagatcctgtttgatccttttggcaatgctctagatccacgtaggcacataagtctggtttttgctttgtttttattggttttagcagctgtagatgctcaatgcctagacccattgaatctttgggggatagaaatggtgatattggccgggcgcagtggctcacacctgtaatcccaacactttgggaggccgaggagggtagatcacttgagatcaggagttcgaaacctgcctggccaacatggtgaaaccccagctctactaaaaatacaaaaaaattagccacacatggtcaggagattgagaccatcctggctaagacggtgaaaccctgtctctactaaaaatacaaaaaaattagccaggcgtggtggcaggcgcctgtagtcccagctactcaggaggctgaggcaggagaatggcgtgaacccaggaggcggagcttgcagtgagctgagatcctaccactgcactccagcctgggcgacagagtgagactccatctcaaaaaaaaaaaaaaaaaaaaaatcagccgcgcatggtggcacgtgcctgtagtcccagctactcaggagactcagtcaggagaattgcttgaagctgcaaggcagaggttgcagtgagccaagatcatgccacctcactccagcctggttgacagaacaagactctgtctcaaaaaaaaaaaaaaagaaaagaaaatggtgatattttgcttctattgtttcattttctcaaattagctgaaatattttgataaagaaccccttctcttatctactagttacccagttatagtttatataggaaaaacaagataattacttgatttttttctcttatttatccagtttcaaaataatgaattcattccctttcctcagaagatcacctgttagtttttctttaaaaataatggccaggcacggtggctcacgcctgtaatcccagcactttggcaggccgaggcgggtggatcacctgaggtcaggagttcgagaccagcctggccaacagggtgaaaccccgtctctactaaaaataaaaaattagccaggtgtggtggcacgcgcctgtagtcccagctactcaggaggctgagactggagaatcacctgaacctgggcggtagaggttgcagtgagccatgatcgcgtcactgcactccagcctgggcgacagagtgagattttgtctcaaaaaaatagggccagacgcggtggctcatgcctgtaatctcagcactttggggggctgaagtgggcggatcacgaggtcaggagatcgagaccatcctagctaacatggtgaaaccccgtctctactaaaaatacaaaaaaattgggcgtggtggcacatgcctgtagttccagctactcgggaagctgaggcaggagaatcgcttgaacccaggaggcggaggttgcagtgagccaagatcccgccgttgtactccagcctgggcaacaagagtgaaactccatctcaaaaaaataatataaataaataaatatatatatatatttatatagagatggatatatatgtgtgtgtgtgtgtatatatatatatatataattataggctgggcacaatggctcacacctgtaatcccagcactttgggaggctgagacaggaggatcacttgagtctaggagtttgaggctgcagtgagcgctgtgttcgtaccactccactccagcctgggtgacagagcgagaccctgtttcttttcttttcttttcttttttttgagatggagtctcgcactgtcgcccaggctggagtgcagtggcatgatctcggctcactgctagctctgcctcccgggttcacaccattctcctgcctcagcctcccgagtagctgggactacaggcacgcgtcaccacgcccagctaattttttgtatttttaatagagtcggggtttcaccgtgttagccaggatgatctcgatctcctgacctcgtgatccgcccgcctcggcctcccaaagtgctgggattacaggtgtgagccgctgcgcctggccaagaccctgtttcttaaaataataaataaattaaaaatcattacgggtttatagatttaaacatatttgatagttttgaatgctttgtaattcttggtcttattaaagttcaaactgtcccattttgctagtggaagttggctctgagtcctcttgacatgacccaagtagtctgtgatagttacctcactatctagcatgtgaagatgttcccagaatttcccatcgtggttttcatttacattgccctgattgagcatcttttcacaggtttattggcttcttcttgaaatgcctgttcatgtcttttggccactttttatatgggtcatttgtcccttattgatttataagggttctttatttttttcctagatattaatagttttggccagatgtttgcagatgtcttttctcaatatggcttgtcttttcagttttggtgtcttgatgatcagaagaagttcttcatgtagttgatttattgaccttttccattatggttttcactctttgactctaggagcttaataaaagcatgaaatatttattgattgtccattgctaatccgaaaccctttcagaatagtcctaacccaaggtctcagtatcagagatgaaggccagttgtgggtgtcaggaggtcagttgtgggtgtcagtcctcagggtcacagatggctcttttagagttgtcttttttttttttttttttttgagatggagtcttgctctgtagcccaggctggagtgcagtggtgcagtggtgcgatcgcgttcactgcaacctccacctcctgggttcaagcaattctcctacctcaggctcctgagtagctgggattacaggcgtgcgccaccacgcctggctaatttttgtatttttagtagagacagggtttcaccatcttggccaggctggtcctgaactcctgacctcaagtgatccacccgcctcagcctcccaaagtgctgggactacaggcgtgagccactgcacccgactagagttgtcttttttttttttttttttttgagatggagtctcgctctgtcgcccaggctggagtgtaatggtgccatcttggttcattacaacctccgccttctgggttcaagcgattcttccgcctcagcctcccaagtagctgggattacagtcattcactactatgcctggctaatttttttttttgtatttttagtagagacggggtttcgccatgttggccaggctggtctcgaactcctggcctcaggtgatccccctgcctcggcctcccaaagtgctgggattacaggcgtgagccaccgcacccagcttagagttgtcttataattagctaaacacagcagtatgtctcagtaaatatcatattttagtttttcactagcttttttttaatgcaacaaattactatcacagaattgtacaatgactgctgaaggccaacactaattatttaaaaggcaggaaattaataaagaagcataaacctgttaccaatgtgaaaactgagcagaacttctaaagctgagctgttaatagttttattcaggcccttgctggctcagcaggaaaatgaaagggaagcagcagccaccaccctgagtaaacatgccctgctttttcttcctccattagaagttcctcggctctctaaacatggcaaagtttggctgaaagtaagtcatgtagttttaaaatgttcatctttgaagtaagctaatcacagaaggacaattactgcatgattctacttgtatgaggtatttaaaatagtcaaactcatagaggcagagaatagaatggcgattgccagggattgggggagggagagatagggagttggtaatcaacaaagttttagtcaagcaaagagaataagttctacagaccccttgcacaacactgtgcctatagataacagtaccgtattgtacacttaaaaatctgccaagagggcagatgtcatgttaagtattcttaccactgtattttttttaaatgacagcttgatgggttttccataaagttatgagtttgtgctttgtaattttttgctgtctaaaattctaagaactacaggtattaggaaatgattttgaaatgattttttctttctttttaaaaacaccattatttaccaaaatgaaaagttagaaatcctgaataatgtcatctcctctttagaaaggaatgcactcttggtatcagtgggcaggatacagcgttgtccagtggactaagaggagcgggagcaccagactcctaccccacctctgcctcttactagccctgaaaccttgggaagttactccagctctgtgggaactggcatagtacctcctggagctgttttgaggattaaataaggttatctcatgtgaggaacatatgaaatggctggactctagccacatgatagtcatcaaccaccactcatgtgatactgcacattttcgcttctgcctgagaagataatgtccactgatagaaaatggaaccataccctgtagtcaggaatccttatgtcattgttttagttttccattgctgccaaaataaatgactgcaaatttacaggttgaaagtagtgcaaatgattatcttagttctgtgggtcagaagtccaattctaaatcaaggtgtcagcagggttgcgttcctttctagaggccctaggggggaatttctttcctgctcatttagattgttgacagaactcagttcctcgaggctgtaggaccaaggtctgttttgctggctgagggctgtttccagcttccttcctctattgtcgaagcctgcagcaagtcgtttgcagatcccccttctgacctcttcttctgcctccctcttagactgcaggcactcttatgcttgaatcaagcccacccagataatccaagatcatctccctattttaagggcaactgattagtaaacttaattccaatgcaaccttaatttccctttgctgtgtgaggtaacagtcacaggttccagaaatagaagacatctttgaggggccattattctgcctacctcatcaagtgaactagaattgtgttggggtctttaacaggtcatttatccttaccttttattttcttcatccaaaaaataaagtggcctgccatataggatagataatgtttattgagcacttacttgctgtgagcttggcccttggcgctaaactctttgctcaggaagagtctttgaggtgggttctattattatccccatttataagtgaggaaactgcattttggagaagttaagtaattgttgaaaataattcaactggtgagggagtcagacatttcagtaggctgctgtacctcaaaggtttggctggctggcaatcagccttcacatggcaggcatactaattagaaatcagtgtcttgattttcttaaaaagttttggttttgctagcagaaattgtcatttgtgcccaggcacggtggctcatgcttgtaatcccagcactttgtaggccgaggcaggcaaatcacctgtggtcgggagcttgagaccagcctggccaacatggtgaaaccctgtcttcactaaaaatacaataattagctgggtgtagtagtgggcgcctgtaatcccagctactcaggaggctgaggcaggagaatcgtttgaacccaggaggcagaggttacgtgagctgagattgcgccactgcactccagcctgggtgacagagggaaactccgtctcaaaaaaaaaaaaaaaaaaaaaaagaaattgtcatttgtgttcatggacgtggtaagaaaataaaaactgaaatcagatatgtatgaaaatgagttacaaaatattctagataaaactttctctgtctgaaaatgcaaaaaaaaatgatttctggcttgtgctaaatcacgaactgttttttgaagtcagaatgttgttttgtctgagatcctggagttctctgccaagagagatctgatttgtgacagggtggtggatgggctcaatatttttttaatgagatattggactgtgctgttttgttatactataagtgatatgtaaccaaacaagaaaattttcctagcaacaaagttgttttcctgaatcagaagaatgcttttgtgtgctcattttcttattgtccaaaagataaaaaagcttgtgaatttagcatcttatttttttgagattgaggtactggcgagtatagatagtagaatatataagaatatcattggaagtatttggcaagcagtatgttaattcagacctaaactgtatttaagtagagaactaacttgtttttttgtttgtttgtttttgtttgtttttgagatggagtttcactcttgttgcccaggctggagtgcaatggcgtgatcttggctcactgcaacctccgcctcctgggttcaagcgattctcctgcttcagcctcccgagcagctgggattacaggcatgcgccaccatgccctgctaattttgtatttttagtagagacggggtttctccctgttgttcaggctggtctcgaactcctgacctcaggtgatccacccaccttggcctcccaaagtgctgggattacaggcgtgagccaccacgccctgccgagaaccaccttgtttttatgccagacccgattgttggacatgattatctcactggcccttataagcctttttttctctcttcttgttcttcattagtctggtgagggacccagacatttcagtaggctgctatacctcaaaggtttggctggcaatcagccttcacatggcagtcatactaattagaaatcaatgttttgatttttttttaagttttaattttgctaacagaaattgttattcgtgttcatggatgtgttaagaaaatagaaacccaagcttttttacattcatcagatctctaagttctaccccattccatttgtttgtttgttttgagacagggtctcactctgttgcccaaactgtagtgcagttgtgcagtcacagcttactgcagcctcaacctccctggcttaagtgatcctcccacctcagcctcctgagtaggtgggaccacaggcatgtgtcatcccacctggctaatttttgtattttttttagagacaggatttcagcatgttgcccaggctgatcttgaactcctgggctcaagtgatccacccgcctcggcctcctgaagtgctgggattacaggtgtgagccactgcccctggctttccatttgtttatgcaacaaatatttgaatagtgtgtgctaggaggccctagggatattgtgccctcatgaagcttacaggttaatgaaagactcaaacatgaaagaaataattacacaatcaggaagtacatgagtgctatgaaagggaatagaaggttctgctaaattgaaggacagggtacaaagaaagccttgatgtaaaggatgaataacatttagctaggcaaaaattgggattgtctggtctcggtcagtggggtatattttgcaaaggtcttgtcccagtagggagtttgtcaatttcgagcaacagcaaaaaggcctctgggttgtaggtgggtgtgtgttcacatatgggtatgtgtgttcgcttgtgtgcatgcatgtgaggaggcagggtggggagtggctctggaggaggagaagggcacagattctcagtcctgtagcactcttgttcagagcatcaagtagacctgagaattgtatgttgatcattggtccgccaagcagttcgtatggccttgtttcccagaactccatcatcaagtggatgtggtgaccatatactttatcatcaaaaccaggatactctttttttttttttttttttttttaaacttctttttctatgttgcccaagctggtcttgaattcccaggctcaatggatcctcccgcctcggcctcccaaagtgctgggattacaggcgtgaaccaacatgcccggcaaaccaggatactcttgagagtgaaaggggacactattaattatgttgggacaacgggtataaaacagtacttatagaccagttctcagccactccagggagccccaaagttgcctagaaaccatgctctgaaatgacagggttagtcacgtgctcctgctttctcaccttttcctcttccttcatccatgaataactctgaaagaggggcaccaggagaaactgctccaagtctatacaacagaatcttagcccccatggcccgcccagctgcagcctcctgtttttcagactgccatctgatctctgactattaatgtgttttcagaattaaagtctaaaaaacgtatagaaaagaaagtaaggccttaaaagtttagcacgtgaacttttcccactagaagcttttcctacactgcttcttatggattacatggcctaattatatgttcccggagggccactgggcagaatgggtgtggtctaacttctttcagagtaaacatgttttgtggattggcccctatggtggataatggtgaataatgcatggagtaaatacctacaggaagccttcccataggtgtaaaacctttatttcaggaaataaaaggaagatatattgattttttaattagaatcaactgtttggctgaatctgcataatgaggattaatggagctttatttcctgctctctctgcccaagtcactctacagtagggccctcagagagccctagtaacttcttcaatttactgacagatggatcactttgcagtaaaataatatttaatggtcggtaactgcgagaatgtgggatctcattgtcctcctcagcctttcttcaacaaccccccaagtcctcaataaaatggtttgaccctgtcccccataataatttttaatgttcatgttcagccaaatactcaggacactaaggagttgcactatttcttttcaaactgcattcaagctctttcttttgttttaaaagccaggaaatgtgaagaattcacctggaactaagtagaaaactccatgctctgccatcttaatcaggtaaaaaacaagaaatttctgtgattattttcagcattgtagtgccagctgaaatgacttgtttttaattaatttaatttaattaattataacagtttcaatttgatgtgaaaatattttattccatcttttagtttctgggcttaaatgctgtgacttacttatttgtgtttgttccactaatgttacctgggttttttagacaagctagaaccagacagttgggatttgtctacaaatgtatttcaaacaattgaaaagtgtcattattccttaggtttttttcaaacaacactttattatagtaagtacacttgtatttatctaatactcagtgaacactggaatgcatgactgttacagagaggctcaaaacactagttatattgtttgtgtatatatgaaaaattgtataatagcacttgtgatttcctggtaattagaagactgtaattgaatttggaagcaacctagatattcaactacaggaaaatggcttaattatggtatatctataaagaagaatattattattctgtttctacagtatttaattgcatgggaacgtgtgcacaattattgttaaatgaaaaaaaggtagtgtgatatgtttatagaggggatgaagccaggagatacgacagaaagtgtgtatctttcagtggcatgatgatttttatatttttttcttctttataactttctgtatttaaaaaattttctgcaatgagtatgcattttataatcagaaaattttttgaaaattggtgttacatttattgtaaatcatggcccttacttaaaatttatgaaaaccctgagtttgaagggtcttttttcctcaagctttctttatatttttggagacccaaagagtcacataaactgagaatttgagagtggttatctggcccaacccccagcctcaagcagactcccctgaaaccctgtatgttccttcttttacaccagcactgatgggaaactcaccctatggggcagccatcctgggacaattctgagtttttggaagctgtttcctctgctaagcaaaaatatgtctccttagtggtcacagaaaacaaatccagttcctctttcacagcatagctgttcatacagtaacccaacatcagtatgttctcagatacaaactattacccggggagcttggtaaaaggcaaagggcaccccagaatcagtatctctggtgaatggggccagatatgcatgggatgtgccattagaaggatgactggagggtgagcagccacagagtgacacatgtcctctagagacttgacttttaatatggttatatttctctctttttttaaatccctgtcagccagaatggatatatttctgtacagggacaatgaaaaagacatagaataaagggaaattaggtaaatatccatttcaattttcaaagatactctgcaccagagttcagcttgctgaaatacacaaccttgacttcattctttattgtttttagatctttattggaggaggtgtagcttttaattataaaagtgattcgtgttggttgtaaaaaatgtttttagctaactgttttaaaagcttgtcttggccgggtgtggtggctcacgcctgtaatcccagcactttgggaggccaaggtgggcagatcacgaggtcgagagatcgagaccaccctggccaacatggtgaaagcccgtctctactaaaaatacaaaaaaaaaaagccaggcatggtggtagttgcctgtaatcccagctacttgggaggctgaggcaggagaatcgcttgaacccaggaggcggaggttgcagtgagccgagatcgtgccattgcactctagcctgggcaaaaagagtgaaactctgtctcaaaaacaaaacaaaaaagcttgtcttatcctttattcttttctttttctttctttcttttttttttttttttttttgagatagagtttcactcttgttgcccaggctggagtgcagtggagcaatcttgctcactgcagcctctgaggcctcccgggttcaagtcattctcctgcctcagcctcccaagtagctgggattacaggcatgcaccaccatgcccagctaattttgtattttttagtagagacagggttttagcatattggtcaggctggtctcgaactcctgacctcaggtgatccacctgcctcagcctcccaaagtactgggattacaggtgtgagccaccacatctggcccctttattcttttttccagaggtaatttttgttaatagtttggtatatcattccagacttttaaatatagatagatagatagatagatagatagatagatagatagatagataggccgggtgcagtggctcacacctgtactcctagcactttgggaggctgaggtaggtggattatatgagtctggcagttcgagaacagcctgggcaatatggcgaaaccctgtctctacaaaaaattaaaaaaattagctgagtgtgatgacgaacacctgtagtcccagttacttggaggctgaggtgggaggatctcctgagcctgggagaaagaggttgcagtgagccatgatcactccactgcactccaacctgggcaacagagtgataccctgtctcaaaaacaaatatatatatttatttatatttaaaatttatttataaattaaataaatttatttatacatttataatatattcatgcatacatgcatgtttttggttttttgacaaaatgggatcatattccacatattgttttacaagttcacagaaaactttctttttactgttatttatctggggggatgggatcttgctgtgttacccaggctggacttcaactcctgggtttaggtgatcctcccacttcacccttctgagtagctgcacagaaaacttactgaaggcatataattgtaattatattatcatacataaagaaattaggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaattttttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggggaaaaaaaaaaaaaaaagaaattaggctggggctgggcgtggtggctcacgcctgtggtcccagcactttgggaagctgaggtgggcggatcatgaggttaggagtttgagactagcctggccaatatggtgaaaccctgtctctactaaaaatacaaaaattagccagacatggtggcgtgcgcctgtagtcccagctactcgggaggccgaggcaggggaatcgcttgaacccgaaaggcggaggttgcagtgagccgagatcacgccactgcactccagcctgggtgacagagtgagactctgtctcaaaaaaaaaagaaaaaagaaaaaaaggaaattaaggccgggcatggtggctcatgcctgtagttcaaactactcaggaggctgaggcaggagaattgcttgaacccgggaggtagaggttgcagtgagccaagatcgtgccactgcacactcccagcctgggcaacagagagagactccgtctcaaagaaagaaagaaattgcactaattccttaacatcatctaatatccagttcaatgtacacattttcctggttgtttcatgaataactttttacagttggttcgtttgaaccaggatccaaacaagatctgcctgttgtgtttgactgataggtctcttagaactgtaatagtttccgctccctcattgtcccttgctatttatctgttgaaaaacctggcttatttgtcctttagaattcctgttttctacaaggattgagctgggaggggaaaaaaagaatttctcatgttctggctgtggccgaatgtatccatttagtatcattctgtttatctcttggtttctttcttctctatatttcccataaacttatagttggatccgaaggcttaattagacttaggttcattttttttttttgccatagacagtactatattaatctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgcaataaatctatcaaattcctggggaagacaaaagcagattaataaactgagatagaaaaaataagctagtagtttacatgtttaagaatttttggttgtatattaaaagatcaagtgaatagtcactggcctctaaaatatttagaaatctccaattgtgccgggcacggtggctcatacctgtaatcccagcactttgggaggctgaggcgggtgaatcacctcaggtcaggagttcgagaccagcctgcccaacatggtgaaaccacatctctactaaaaatacaaaaaattagccgggcgtggtggcgcctgcctgtaatcccagctactcaggaggctgaggcaggagaattgcttgaacccgggagatggaggttgcggtgaaccgagaggacgccactgtactccagcctgggcaacaagagtgaaactccgtctcaaaaaaaaaaaaaaatctctaattgctgagtatattcattacaaattatgaaaaaaagccaggcgtggtggctcacggctgtaatcccagcactttgggaagctgaggcaagcagatcactttaggtcaggagttcgagaccagcctggccaacatggtgaaaccctgtctctaccaaaaatataaaaaattagctgggtgtggtggcgggcacctgtaatcccagctacttgggaggctgaggcagaattgcttgaacctgggaggcagaggttacagtgagccgagatcacgccactgcactccagcttgggtgacagagcaagactccatctcaaaaaaaaaaaaaatatgaaaaaagcaatctggagaagactcagtttgtctttgacatgtctttgactatatgtgtattttattccagaaaagtatgatgggggtgatgcgaggaaaattacacatcaaactgagggtgatgtaatcatgctttccagcagatagatggaaatgtagttgtttaatcttcagatgtgatgtgtactgtgccatttaggcatttgttttttatttattcatccatctagttggttaattacactcagatacacagccaattgaggatctgaatgtagtgtatatgtaatgttgatggaacacaaaatcttttttttttttttttttttgagacagagttttgctctgttgcccaggctggagtgcagtggctcagtcttggttcactgcgtcctctgcctcccgggttcaagcaattctactgcctcagcctcccgattagctgggattacaggcgcccgccaccatgcccggctaattttttgtatttttagtaaagatgggatttcaccatgttagccaggctggtctcgaactcctgaccacagatgatccacctgcctcggcctcctaaagtgctgggattacaggcatgagccaccacactcgacctttctgattcttagtttaactgtctttaaaatgggaataattacagttttctctggctcatgtttcttatggtcatataatggtgatgtaaatattttctatggtttctctatttatttatttattttgagatggagtttcattcttgtcgcccaggctggagtgcaatggcatgatctcagctcactgcagcctctgtctcctaggttcaagtgattctcctgcctcagcctcctgcgtagctgggattacaggcacttgccaccatgcccagccaatctttttgtatttttagtagagacggggtttcaccatgttgggcaggctggtctcgaacttctgacctcaggtgatccacccgcctcggcttcccaaagtgctgggattacaggcatgggccaccgcgcctggcctggtttctctatttaaatctgaagaattttcataatgcaaaattttttctggcacagttacttatgtttttcttttctttcttttagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtt

SEQ ID NO: 4430 - DNA, 74581 bp, human
gcgttcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtgagagcgtggagtcgagtcacagctgtcaccgccccctcccggccgcccgagccctccccgcgctctcttggggcctctctgcagccaggcctggctcaccccgaggcttttcccgccactgggccggctgcgtcccggccccgcggttcattcactggtctactggggatgagcggctgccgggcggaggcgggagacccccgggtgggtgggggcggccctttgggttgtgctttcgtgaattaaacactttgaaaatttaaagtgccttcccccaaagtacccatcccctcggctagtaccctcttgggatcgtgggtagggtgaggccagctcagggcactgtggggttcgcggctttagttgcctggcagggtcaggtttcagaacctgatgtgtggatgggggagggtcattttaggagaagctgtgcagggtatgggggaggctggggtgggatggctgggtgacgagggaagctggagctttgctccactcctcagggaacattatttaatacgggccagtggacccccttccctgcgttttgtgaactcgtgtcctttggaaaaaaatcgacttttacgatgaagacttaatttcgaaaatctgcactttagcataaagccattattctactttttaaaaagtaaattatatgtattttgtcataaaaaatcacaggctaccagaaattaatctacaaaattgagtcttcaagaagcatagtacccataaaatagtgctaatgaaatctcagaattgtactattcatttaaaagttttattgagctctgcaatgtgctttgggtacgttaataaaggctgtaaaatcagaacatgcattctgccttctagtcctggcattgccactttctagctgtgtgaccttgggcaagtcactgtgcctatcttcctttggtgaagttggggtaataacatctacctcatagggttgttataaggagtaagttggtatgtgtaaagcacttggaaaaggcctagtatttgctcttactctgttttcaggcagctcacagtttagtcaggaagacagatcctataatcaacattcatttgataaatttgtgtgttaaacacctgttatgtgctaggagctcagctccatttcagggttacaacaaggaaagatatgctgtggccagtttaactatatgtgtaccaacagtgtagtaaagtagtaaaaaggagagcaggatccacttggcttaaccaggggttcctaacctggggccctcagctcctcaaaggatctgcacatagatttcagaggatccctgaactttgatggggaaaaaacataactatttttagcaatctccaattggaattgagcacttcctttagttacgcatatgggtaatgtctcagttatctattgttgggtaacaaatcactgcaaaccagtgccttaaaacaagaattgtttctcaaaatctgggttggctgggcagttctgctggtgacttgactgaaagttggcttcactcccatgtctgggggcttggtgcccctccatgtgcctaggttggacttcctcacttggttactgacttccaagagggcaagtcccaaggcacaaacacagcatcatgtttgctgatgtcaaaacaagtcacgtagccaagtccagagttgatatggtggggaaccacacaaggtcatagatatgagttggtgcacttcgctgggggccattcattttacaagttcctactgtaacaaatcacagtagtattagcagtacctgttaccagtagaagtcacagtaccagcacaagtcacagacattttcatattacattacagttgttgcagatgtcaaaatatcacttatgctcattactacttcagaactatggtagttataagactcactgctagatctttttgtttagtgggctagtaaagaagcacatactgcttatatcagatatttgagtttaaaaaataagattatttcaatatagttgggacttttttgtatgcaattagaagcattattttgagaaggagtctataggactcactgacggccaaagaggtccacggcagaaaaaaaggtaaggaacccctggggacttcagagaaggcttcacagacgggacacttaaatttagttttgagacaggtaggagttcttcaggtaaaaggggtggggaacatcagtggtattccattgggggaagtgctggaagctcagttttgatgtgtcaagggaaagacatagtgagctgagattattattattattattattgttatcattattatttttttcagacagagtctggccctgttgtccgggctggagtgcagtggtgcgatcttggctcactgcagcctccgcctcctgggttcaagtgattctcctgcctcagcctctgagtagctaggattacaggcgcccgccaccacgcctggctaatttttttgtatttttaataaagacggagtttcaccatgtgttggccaggctggtctcgaactcctgacctcgtgattcgcccgccttggcctcccaaagtgctgggattacaggtgtgacccaccgcgcccgactgaactgagattatttcaggtgaacatgtactttgggtagaaaagatcacaacaaaccttggaggacaccaaaatgtaggagtaggcagaggaaagggggaggccagacttgagaagcagaagtaggagcagaaaagagtgatgtttagaaaatcgagggagaaaagtttcaaggagaaatggctatgttaggatgctttcagctgggaaaacccaactgcttaaatagtaaggaaaattctctcacaaagtccagaggaagaatggattccaggctctgattcagttggtcaacagtgtcaggccaggcacggtggctcacgcctgtaatcccagcacttcgggaggccgaggcgggcggatcacgaggtcaggagatcgagaccatcctggctaacatggtgaaaccctgtctctactaaaaatacaaaaaattagccgggtgtgttggcgggtgcctgtagtctcagctactcgggaggctgaggcaggagaatggcaagaacccgggaggcggaggttgcagtgagctgagatcgcaccactgaactccagcctgggagacagcgagactccgtcccaaaaaaaaaaaaaaaaaaaaaaccagtgtcatcaaggacccatctcttcttgggtttccacagtcaggttggtttcctttagggttgcaagatgactactagtaacatacacactttctcattctctagagcaagaggaggaggagagagaaaaaactcccacacttggtccttcagtctgattggaccaacttaggtcagttgtctgaccctgtaacagttgtcagaggaatgccatgatctgattggcttagactaaacaggatcaacccagggtggcgtcacttaatcacaggggagaggaatgcattcatgaacacaatggagttcttttaggaaggaagagggagaatagagactggatatgcaaccaacaatgtccatgacggagatataagctagatgagatatgagttagttacatatcatgagtcgtgttcactgatttgggcactttggaaagctttcatgatccttatactttaggtttactgatggaagtgaagggtagattaacctgggttggtgactgagggccaagtaagtggacactatgatggttgataagcttgactatcaagggaaggagagagaatttggtaactagaaggatatgttcagtcaagattctagagagaatacctcagctgtgcaagggagagatattcccacccgagagatggaaggaaaagaaaggtgcgagagattgtagaccagtggttctccatagaatggtacgactcaacagaatggtatgttttggaaacttgtggggttgttctttttttcttttttcgtttttaactttgcaaaaattataactgaaaatggggttgttctttatgtctttagttgtgttgaacatttacatactgaaatataattcacataaatctttcctttttattcacctttatgctaccatcagagtatactgatttactttttggacttatgcatgtaacttagtgatgaattttatttcaggataccagaagagtgtcagaaaatatttgtcataaaatggtgatgttaggtctagtagttgagaaccagtgcttgtcaaactttaatgggcatgtgactcttgttaaaatggattccaattcagtaggtctgggatgcggcctcaaatgctccatttttttttttttttctagatggagtctcgctctatcacgcaggcttgagtacagtggcgcagtttctgctcactgcaacctccgcctcccgggctcaagcaattcctctgcctcagcctcctgagtagctgggattgacaggtgcgcgccaccatgcccagctaattttttgtatctttagtagagacggggcttcaccatgctggccaggctggtctcaaactcctgaccttgtgatccacccgcctcagcctcccaaagtgctgggattacagacgtgagccgccgcacccggccagattctccattttttaactagttctatagttttcgttggtcccctttgactagcaagaattgaagccaatcggtagatgaatggttcttgtgttttcgagatggatggtcttatgaacatggtgggatttgggagaggcactgaccaaggaacaaaaagataggccagaccctttgagggctctgctgagagcactcctgtatgtttgtgcagagtggggatggagtaaacggtaggattgatcggggtttgggagttaacagcttgggttaactagaactggagggcaaaggagttaatagtataggtgttggtagtaaaagtacaatggtagtaaaagtgcagtgtgtctgactagttatgtgcatattaagtacacattgtacttaaaatatatactgcgatgttttgatatagttattcatcttcaggtcactagggggcattggtggattaaaaaacacatttgaaaagctgcccagtatttgcattccattgtaggaagcagcttttccttgtgctgctgcaggaagtttgaatattggatacatatacccagattcacgttattagatttccttcattacacagattttatcctagtccaactatgggctgggcatcatgctggaccctggtgggtacaagtgaaaagacccagttcttatctaggagagaggtcccaaatctggccacaaatcagaattattcaaggagacagtttccaagcccctgcgcatggttctgactgactttttagttggcgtccaggaactgctagttttgaaaaagccccccaaggtgattatgaaactttcatttcagaagctcacaatgcacttaccagcacagacattaaaggtccgttaacgatgcagtgggtctcaaccttgactgcatgttagagccacctggggagcttttaaaagtcccgatgcccagtctagaacctataccaatgacatcaagaatctctaggggtaggattaggcatctagtttttggagcaagcagccagccttgagatctactgacttagagggaagagcaacagcagggggcatcagaaggctttatagagaagaacatgcctatgctgatctttggagctaggcagacaaggttgaaagggccttccaaacagagaagaaaagcacatgcaaggacacagaagtgtgagagtgttcagaacagtgttaagaccttgggcttcactgtgttccttgtgagagatactaaagttttctgtagctgcttcctcatttgtaaaacaaggatgagatgcttaccaacctcaaattattgtgtggattaaattcattcctacgcaaagcttagaacagtgcttggcccaaagtaagggctgaagaaatgtgagctgttacttttagttggcatcttgtaagatggcatcttgtaactacctgtgttacggtggtgcacggtcttggggctctccaaaagtattttttatttcaaaacttggtagtcagttggatgtggtagatgagggagaaggataaattaaggtttctgcccaggcttttgacttttgactgtgggatctattcattgaggtgggaactattcattgaggtgggaaagtggaagaaggttgaatttggtttgagggggaggtgatggtttggttttgaacaggttgggcttgctgaaatatctgggcattggaagggggaaatcagttgatgtagaaccccagggtatggacttttcctgccacagacgtgggctggaaattgggaaatcatcagctgctaactgaagcctccagggcaagaaggtggcctagtgaaaactggtctgtgtcacttccttcctcaagggcaaataacatgacctgtactcagagctcaccacaccaaggagcctgagtgaacatgtccatgactatgaggtgttattacctcacacattctttgtggcttagtgtaatacttacattgcctgtcttcctgaaattaattttcttaccatgttactagtatgttactagaactgcgcggagaattacaatgctaaatggaaaaggaaaatcatctgtaaattggaagagtaatgtaacttttatacttgagcattattttaaaagccacatatttggaaagataatgaaggttttttttccctaacagtttaagcatcttcaagggaattcttcttgaggaattatagtaactacatttttactcacataaatacattttttatgtgcagaatcaattggttgtttctttttcctttcttacctttcgaagaagttagacagtggatcacagagacgaagaaaaaactgctctgtagctctggatgcaatcttttcagcctcaggttctagttgtgtttctggctgagcgaccttgttgagatttctttttttttttttttttttttgagccggagtcttgccctgtcacccaggctggagtgcactggcgcagtcttggctctccgcaccctccgcctcctgggttcaagccggtctcctcccttagcctcccaagtagctgggactacaggcatgcaccagcacgcctggcctagtttttgtatttttattagagatggggtttcaccatgttggccagactggtcttgagctcctgaccttaagtgatctgccctccttggcctcccaaagtgctgggattacaggcatgagtcaccatgccgggccagttgagatttcttaatctctcagcgtcctctgatcatgatcctgtggggatagtagtatgtccctctgtatctcacaggattgttgggagattcaattgagataatatgcgaaaagaaccgtgaactacaaagcactatatcaatgtaaggtgttttctgttcctcttgtatcacatttgtccactgaagtaatctatgcttgcaggttagcactctggacttaacaactgtaaaacgtgaattaacttgggttatttcacttctcatttggaaatgaattctgctcaggacactgtagcattcttctatctacttctgaaatgcagatagcctcacagttgtaactaacactggaagaggagaaagaagaagtaaaacgatacattaaaagaacggagagattagaggcacagtggaggagaaaagtagatgatgtaccagacatttatgataaatgaattgattaccccatgaggcctgttgatatttgtagacttttatgacgtaaaggtttaatttataatctatatgtatatgtgttccacacccatgtcctttctaggctagactggaacttcttagaggctaggaaacgaacttgcatatttgtttgtattgtacatttaaaattagatatataaatgcatgttattaggtgtgtaataaatctcaatagcaaagatatctgtttcaaaaagtttagacttatttttaatatgacaagaaagtactaagagatctttaaaataaaggaattgaaagagtgtatcagttgattttccccaataatgcttaagtggaattttacagttagttcatacagcatgaaactttatatattttcagggacaaaaaaatcctagtctaaagttatattttagaatttggaagttatttatttttcacttttgctgagtttttcctaatttttgcatagcctcatgccagttttgttagaaaatttaatcagtgccaatttcttaatgtggtaggtttttaaacttattttcagtgttcactaaaacttggagaagcaggaatgtagggcaagggtcgtagagttttcagtatgctgaaagcctatgactttgattgttaagctatattttcctgatacagctttatgcattatggatagtatagttgaattttaagtgaatattgttttaaaggcactttaagtgcagttatcctttgtcttcctatttctggctgtttgaagcaatgcagcgtgttttattcaaagcccacactggctcccgcttaaggacttctttgtttggttccatgaggatgaggagccccctctgtgggagctagagatagatccacaagtgcatgttcattgccttagtgtggaggaattcccagtagtttcttttttcagatattcctgaaaagaagtctattccttcttctgaacagtcttttaaaatggaatatatgaaactaactaataaaggttctttttttcttttcccccattccacaaacttcagtccttgtgaactagcctgtttttgtttgtgcttgctgaaaatgagtctcctctcctattagagatgctgattcatgtgacatgggttagactggtgagtgagtaagtaagcaaaaagtgattatacgggctccaagaagtttcctacattgtctgttgatggtttacctcacttggcagatagaactgagcctgtttgtggagtcacaccatttgggagtcctgttaaagttgctgggtatagtccaaacatttactttacttgtttttgttccttatttttgcacagattttcattatgaggtcagatggttatcaaccgaattgagtcttgtacatgattttttttttccaaaaaaggcttacagttttccttaaagaagaaaaacgcacatgaataactgagatgaagtcaaaggcagttttcattagtgagtttagagttctctgtgcacatggtggtctgttaagatatgaaacccgggtctaggcccgacgtggtggctcacacctgtaatcccagcactttgggaggctgaggcaggagaattccttgagtccaggagtttgagaccaacctgggcaacatggcgaaaccccgcccgtctctacaaaaaatgcaaaaattagccaggtatggtggtgcctgcctgtagtcccagctacttgagaggctgagatgggaggatcacttgagcccaggaggttgaggctgcattgagctgtgattgtgccactgcattccagcctgagtgacagaatgagaccctatgtcaaaaaaaacaacaacaaaaaaagagatatgaaacccatgtctaggtagattttttttttttgagacagagccatgtgtctagatagaaacctgtgtctagatagatttttttttttttttttgagacagaatcatgctctgtctcccaggctggagtgcagtggcacaatcttagctcactgcaacctccacctcccaggctcaagcgatcctcctgcctcaccctcctgggtagctgggactatgggcacgtgccaccattcccagataattttttgtattttttgtagagagggggtttcacctttagcctgttgcccaggctggtcttgaactcctgggctcaaaggatccgcccacctcggcctcccaaagtgctgggattacaggcatgagccagcatgccctgcccagatagattttactttgacagactagctctcctattaaatgatgtacattttattagttgcttggaaacacagatgcatttgaaaagctaaacttgaagtaaatgtttcccaacgattttttcctccctatatttccttaattcagaaaagattgagtgggtcccaggatgccattctaatagagaaaaaaacacatatatataggagtcttaagtagcagtaaatttctgtctggatgaggaagttcaaaataaattctggacttgataaattacatattatctgtgttccaagtctttaaaaccagtatagcccaactggatgactcaaaacctgcctaaatgaacaattatctcactctttggccctaaggttttcttcctgtttatcgcacaagtttattatttttctacatgaattttataaaatctaatcgctatctttaaagagtagaaaatgaaacaattgcagatgagacattttgtttgctttgctgacctaattttgtggtgaattctaccctccaaagatgaaacagaacttggttttctgtgagaaaaagataatattagtcttgaaaacagcctcatttttttctctgcttatctctttagattgtagtctgtttacagtggatgagaaagagctaggaaataccaattactgtagtacagaactaaagaattaaaaatttctcataaaatagttctatgtttgttgtattaggaagagtttttttaatgttgtttgaagtctaaactttactgggcatggtggttcacacctgtaatcccagcgctttgggaggccaaggcaggaggattgcttgagaccaggagtttgagaccagcctgggaaacatagtgagactccatctctaccaaaaaaaaaaaaaaaaatagctgagtgtgctccgtcacacccatagtcctaggtacttgggaggctgaagcagaaggattaggtgagcccaggagttcaaggccacagtgagctatgattgtaccactgcactccagcctgagtgacaaagggagataaattcttggctttatatcctcctttgctgtgaaacagatcgaaatgattgtgggttttattgttattgttaaagtatgagtgctcccaaattttacattcaaatgaatgcatcaaaacagtcgttttgagaggatagatttaattatactgtcattatatttattccaaaaattctatcactgatcaaaacatttttactcttcctcatttggaattatcttcaaactttgtggcaaacctttataatatcctcaggagctagccatttttgttctttgcatgttacaaaacaaatcaatggtttttttgtaaaaacttcaggaaatagagataagaattacctttaatatcaccacctatagacaaccactgttaacatcatattttttttttttgagacggagtcttactctgttgcccaggctggagtgcagtggcgccatcttcgttcaccgcaacctccatctcccgggttcaagcaattctcctgcctcagcctcctgagtagctgggattacaggcgtgcaccaccacgtccggctaatttttgtgtttttagtagagacagggtttcaccgtgttggtcatgctggtctcgaaccactgacctcgtggtctgcccacctcagcctcccaaagtgctgggattacaggcatgagccactgcgcccggccctaacatctttttagactccgttctggacatattcaaatatacccttggtatgacattttcaaaaaactcggtggaatcatactacaagtccccttcctcttttttttttttaaaaaaaatgccattttcttttcttcttcttcttttttttttagtagaatgagataatcttattattgaccaagtttacataaagcttgattctttaccgccaccaccaccacaacagaaagaaaagtttatgttggacactacgtttaattaggagatgtagaaaaggttccagtagagattgttttaatgaagactaatattgtaatttttttttctattttactctaagtcctgggatacatgtgcggaacatgaaggtttgttacataggtacacatgccatgttggtttgctgcacctatcaacctgtcatctaggttttaagccccgcatgcattaggtgtttgtcctaatggtctccctccccttgccctccatcccctgataggccccagtgtgtgatgttcccttccatgtgttatcattgttcaatcccacttatgagtgagaacatgtgatgtttggttttctattcctgtgttagtttgctgagaatgatggtttctagcttcatccatgtccctataaagaactcattctattttatggctgcatagcattccatggtgtatatgtgccacattttctttatccagtctatcactgatgggcatttgggttgcttccaagtctttgctattgtaaatagtgctgcaataaacataggcgtacagatgccattttctcatctttgtgtgtgtgtgtgtggagataatgaatctttttttttttttgaggcggagtctcactctgtcacccaggctggaatgcagtggtgcgatctcggcccactgcagccttttgcctcctgggttcgagcgattctcctgcctcagcctcctgagtagctggggctacaggtgcccaccagctaattattgtatttttagtagagacagggtttcacactatgttggccaggcttgtctcgaacccctgacctcaagtgatctgcccgcctcggcctcccaaagtgctgggattacaggctcgagccaccgaatccggcccattctctattctttaccactcttatttaaaatatatcgagactgattttctttactttttttttttaagcggagtttcactcttgttgcctaagctggagtgcagtggcatgatctcggctcactgcaacctccgcctccagggttcaagcaattctcttgcctcagcttcctgagtagctgggattacaggcgcactccaccatgcctggctaattttttctatttttagtagaaacagagtttcaccatgttagccaggctgctcttgaactcctgacctcaggtgatctaaccaacttggctttccaaagtgctggattacaggcgtgagccacggcgcctggccgagactgattttcttttaggcttaaaatgtgatctgaaggcatttagaaatggaagccatatgattacatattaaaagtaaattttggttgggtgtggtggctcatgtctgtaatcccagcactttgggaggcctgaggtcaggagtttgagaccagcctggccaacgtggcaaaaccccgtctctactaaaaatacaaaaattagccaggcgtggtggtgtgggcctgtaatcccagctacttgggaggctgaggtaggagaatcgcttaaacccgggaggcggaggttccagtgagccgagatcacaccactgcactccagcctgggtgacagggcgagactctgtctcaaaaaataataataataaaataaattttaaaaaataaatttcacttatgaaatttatataaatagttgtagtaaattccgactccatatatgatttatcaaggtaactgctttgaaaagaaaacatctatttaaaaaaaatgttgtaagtaatactgaaatacttttccttgtaaaaagtcaaaatagtacagttggtcaggttgctattgtccacctccccccagccccctttccagagaaagcctctgttctgtttggtgtgtggccctacatgttagaaaggattgctggccgggcatggtggctcatgcctataatcccagcactttggaaggccgaggcaggcagatcacctgagatcaggagttcgagaccagcctggccaacatggagaaaccccatctctactgaaaatacaaaaaaaattagctgggcgtggtggcaggcacctattattccagctactcaggaggctgaggctggagaatcacttgaacccaggagacggagattgcagtgagccgagattgtggcactgcactccagcctgggtggcaagagtgaaactctgtctcaaaaaataaaaaatataaaaataaaagattgctgtataaaatgtagatactgtcctgaatgctccttatggaggagagtattctgtattcttttgacgtttcaagaattgtggactcatttctcttgatttttatttttatttatttatttatttatttttcagacggagccttgccctgtcgcccagactggagtgcagtggcgtgatgtcggctcactgcaagctccgcctcccaggttttctcctgcctcagcctcctgagtatctgggactacaggttcccaccaccacgcctggctaatgttttgttttttttttttttgtatttttagtagagatggggtttcaccatgttagccaagatggtctcgatctcctgacctcgtgatctgcccgcttcggcctcccaaagtgctgggattacaggcgtgagccaccgcgcccggcctttctcttgatttttcattcaatttacaacacgttactgaggacaacagtgtagcctgattttgacaaaatttttttattgtcttcatcattttgttgtattctgagttctttcacatagttcttttttttgtgttggttacttagaataagaataatctcaaaagtattgtcagtgttcatagtttgttttttttttttgtaaaaaacccatttcagatttttacctcctaaataattagaatcagattaaaatagttttgtttcgagtgaaaaatgctgtcagaatggaaattattgcagaaaaggttgactgaggccaggcgcggtggctcacgcttgtaatcccagcactttttttttttttttgtgacggagtcccgctctgtcgcccaggttggagtgcagtggcgcgatcttggctcactgcaagctccacctcccaggttcacgccattctcctgcctctgcctcctgagtagctgggactacaggcgcccgccaccatgccctgctaattttttgtatttttagtagagatggggtttcactgtgtttctaggatggtctcgatttcctgacctcgtgaactgcccaccttggccaattccagcagtatgagaggccaaggcaggtggatcacctgaggtaaggagtttgagaccaccagcctagccaacatggtgaaaccctgtctctactaaaattccaaaaagtagctgggcatggtagcgggcgcctgtaatgccagctacttgggaggctgaggcaggagaatcgcttgaatccgagagacggcggaggttgcagtgagtggagatcgcgccactgcactccaggctgggcgacagtgcgagactccgtctcaaaaaaaaaaaaaataattagctgggtgtggtggtggctgcctgtaatcccagctacttgagaggctgaggcaggagaatcgtttgaaccccaggggcacggaggttgtcttgagccgagattgcgccacttcactccagcctgggtgaaagagcaaaactctgtctcaaaaaaaaaaaaatttattttcattctttatcattaaagagttgcttttatgttgtcctttgtgtggcttgtaggatcattaaataaggtagagaatctcataaaaacagttttggagaaagatagttgaaagcataatgtcatacattttaaatatataaatgtaaactatatatagaaatacataaagtattatatatacttaaactatataaactatatttttaagtatatatagtatgtataagtctataagtatatatatacatatagtttatatacatatatataaacttggtagaagggtaagatactgtaagtgtatatatacttacatagagagagtttaaattatttacatggaaaatagaaataatatattccatcactccaaaaaaaaggtcacctttggatatagcctgtttgaagtagcagttgaaaagcctggtaacatgtccctcagggagttagaaacacaggaaacacacaagcctgaggcttagggagaggcccaggctagggatactgatttgagcatcagtagcatatgagtgggagttaaagacttagattttggccaggtgtggtggctcacgcctataatcccagcactttgggaggctgaggcaggtggatcccttgagcccaggagtttgagaccagcctggccaacatggcgaaaccctgtctctactaaaaacacaaaaattagctgagcgtggtggcgggcgcctgtaatcccagctacttgggaggctaaagcatgagaatcccttgaacccgggaggcggagattgtagtgagccgagatcaggccactggactccagtctgggtgacagagcgagactctgtctgaaagaaaaaaaaaagaaagaattagattttaatgaaattgccctggagtgagaagaggagagagttaaagactactccatgactcatcaaccttgaagagctatgcagaggaagagaaggcccaaaaggggaggagagagtacctagaaagcctctagaatggggatagggtagaatcctgtaagccaaagaaaggggttgaagatgtagagtagtcaccagtttcagggtgcaaccaagatgccagatgtccagtggggtttagcaactgggaggctattggtggtcttgggaagaaaggttttaggtgcatttagtagtaaagggaggaggagataaaattgagaaagcaaacagaatctgcctttttgactttgtgcttaaatgcggatgctcctcagcttgtggtggggttgcattctgataaacctatcataagttgaaaatatcattaagtcaaaaattaacacacctaacctaccaaacatcataatttagcctaccctcccttaaatgtactcagaacacttccagtagcccacagttgggcagaatcatctaacacaaagcctattttataataaactattgaatgtttcatgtacattattgaatactgcactgaaagtgaaaagcagaatggttatatgggtactcaaagtgcggtttctacagaatgcgtatcgcttctgcaccatgtaaggttgaaccatttgtaagtctgagaccatttgtataacatacatataggaaagtaaacggggcataagtgaatttttacaaactaaacatactagcactctagaagctcttctcgtggcccttctagtcactacccagcttgctaagggtatccactattctgccttctaaccatagtctacttttaaaataaatttgtcaatggaagttggtagaagggtaaggtagttgttagagagggaattaggggtggagggtatttgttgtgttttgtttaagacgggagagattttcttgaatgtaaataaatgtcataatttctctagtgggtggccagtcactctgtttctttttatatttaggacagttttcattttatactttcaaatgtttttaaaagtatgtttgagtgcttatacaaacttaagttgaataactgttctctaagcatatgtttgtggaatggtggttttcaaaactttgcttatcttgggaatagattcttgggcccctcttagattcagagtcagacactctgggggaagctgttagaatctatgcttttaaaaaattccccaggtgggccaggcgcggtggctgacgcctgtaatcccagcactttgggaggccgaggtgggcggatcacgaggtcagaagattgagaccatcctggctaacacagtgaaaccccgtctctactaaaaatacaaaaaattagccaggcgtggtggctggtgcctgtagtcccagctaccaggaggctgaggcaggagaatggcatgaacccaggaggcggagcttgcagtgagccaagatcgcaccactgcactccagcctgggcgacagagcgaggctctgtcttaaaaaaaaaaaaaaaaaaaaaaaacaactccccaggtgattctgaaacctcttgtgtacacaggcctgcaaaagccttctatcatgaagctggcatatattataaatggaagtctaataagataatagttctgtaattgtgggagaaaagagtcaccctttttttaaatgggagagagtattcactagattctctataaagttgaaaaagaaagcaagttgttaggtatttgagccccaccattcatgagagtctgaataattctgagggtgacttatttagcttaaggtttttatttgtctttaaggcagttttactggaacataatcacaacatgatcccagagctatggaattctgggcagtcagtgtacttttatttgcaaagcaagaacagtttagccttctggacacccattatgatttgtttgtttacgaccttaccagattcatgtcttggtaaactgtgtctaagaatctacctttaaagctgagggagctgactgataaactcaatctttttattttattttattttttgaggcagagtcttgctcagtcactcaggctggaatgcagtgacgcgattatagctcactgcatccttgacctcctgggctcaagtaatcctcccacctcagcctcccaagtagctgagaccataggcatgccccaaacacctggctaatttttttttttttttttgtagagatggagtcttgttatgttgcccaggctggtcttaaacttctggcctcaagtgatcctcccacttcagcctcctaataaactcaatcttatgcctgaatcttttttttttttttttttttttgagatgaaatctcactctgttgcccaagctggagtgcagaggtataattttggctcactgcaacctccaccttccaggttcaaacgattctcttgcctcagcctcccgagtagctgggactacaggcacatgccaccatgcctggctaatttttgtattttagtagagatggagtttcagtgtgttggccaggctggtcttgaactcctgaccttgtgatccacctgcctcggcctcccaaagtggtgggattataggcgtgagccactgtgctgggccctgaatctttttttgaatgttaatttattttttaaattgtggcctgagtctttgattaaattcataagcttcctggaagctctataagagcagggaccttgtctgcttatgtgttttatctgtttagtaccatgtctgacatgatgtgggtgtgcagtaaatatttgtttttgaaataaaaccctggttgacctcttctaattgttatatataaccttgcttgcctgaccagatttgttttgccaacatcagtccttcgcaagcttcagtggagacagagtaagaaccaaatgtctttaagatgatgacagcctacccctttacacttcttgttagggcctcatctaacccaacaccaatactggttgctctgtttccattgacaagccccttgcgggctgtgcgaaacaaaagttttgagacatagagagtctaaggtccaagatagagtgtaccttgatactttgctggggagtaggatcagaccagaaagaaagaagagttagccacaagagtgagaaaactcaatgacactccctctgaggtttgcaaagctaagggccaccagtttacctttaagccaaattttcgttttctctgtgactatgggtcttacagctgtattcaaaacctcagagaagccaacacattagagtccttactttgagacccccaactagctgaatgccaagaaaggcatttagtaactgaagggtatactcccgaggggctggatctaaagaaatgccacctttgatctagcctgtaacttagcactaattggagattcagctcttaacagagcttgcttgactttgattgagcaagcctaactcatataatgcaaagtagaccatatctaatcagttcttggcaggtgcatatgtactcattttctgagccaactcatctgccctgaccagggagtgtacctggcaacaaggcttctcaaggactatcacttgggaaagggagtgctcagggcgtgggtacatgcagtctagagattacagccctgcatcagaaaaagtttgggggaggccgggcacagtggctcatgcctgtaatcccagcactttaggaggccgaggcggacggatcacaaggtgaagagatcaagaccatcctggccaacatggtgaaaccccgtctctgctaaaaatacaaaaattagccgcatgtggtggcgcacacctgtagtcccagctacttgggaggctgaggcaggagaatggcttgaacccaggaggcggaggttgcagtgagccaagatcatgccactgcactccagcctggcgacagagggagactctgtcgcaaaaaaaaaaaaaaaaaaaaaaagggaaaaagaaaaagtatgggggagatttcacttcttgggaggtatattcagtccgattatatcataatgggtcaggactcctcatggagagagaatacctttgtgttcatgtctcacaaagcaacccatccagagtgcgaacaggaggaaagttgataaggctagagatttttttttattatgtcccagaccctgaaagttgattgtgtttcttcaaagaactggattgttcttccttggggagacaaaagattgaagaaggttcatctcctctttgtgcccttacactgtcctggggtgattctacccatcttagcctttcccttcttaaatcctgattttgaataggttggcctgaatactcaatatgagccctaacaaattatgataaccacctggcaggcacacagtgtcgaagatggccatttgtgatgacatctggtctggccagcttcctttttactgttaagagggaaaggtggtgagcatgctgaggcagggtggggtcatctcgcaccaggaggagccccctttgaagctaaaaaggaagatgaatcagccaagatgttgagtgcatcagcttcagccatgtctacctggggaccttttaccaaggctcctcccatgggtttccatcacacagatctataccagttccttaccatggtcaggtgtgtggctggctccttaggaatgagcttggcatggattaggtgtgctagagctgatggattttttaaaaagtctaatttacatagagtgaaatacatagatttttaagttgtacagtcttagttgtacaatttgagctttgacaaatgtatataccttgaataacccataccccaatcaagattgtttcaccccagaaagttcacttgtgccacttctcagtaagtccacttccttccaactcccacctccccggcctagtagtgattgttctggtttctcactatgtttgaggccatgggttttaaaacatacagattttcttcaagtctagatggtgagagatgtcagaaagtaatacttactcaagtaaatcagaggttctcagtgggagagttgctccccaggagacatttggcagtgtctggagatgtttttgactgtcgtgactgggaggaggtgctactggcatctagtgggtagaggctagggatgctgccaaacttcctgcagtgcacaggacagccccacaaagaaggacccaacccaaatgtcagtagtgctgagtttgagaaatcctcgagtaaatcatgtgttctctgcaaactaagaattatggtcctggggagtgttcatttgtaggtctcccaggtctcctggggtgaggtttgctttttctttgttttgtttgcttgtctgttgagagcctgctggaagctgaaaaggccgctgcaggagccagctttctttggtgctaccacccttgtggccacagttcttgctgtggaatgggtatcagggtaggcttagggaggaaaactaataggagaagaggaagaagaagaaaacagtttaggcagtaaagggaggcaggcctagaataatattaaaactagaaaaacaagtaagataagaggggaaggtaaagtagaaattaataattaagaatccaataaaatgttaaaggaaatgagttgagatttaaaatcaaagataggctgagtgtgttggctcacacctgtaatcccagcactttgggaggccaaggcgggaggattgcttgagctcaggagttcgagaccagcttgagtaacatgatgagaccctgtctctgctatatatatatagttatgtatagatatagttatatatttatatatatatataatatatatatttgccgaggctggagtgcagtggcacgatctcggctcactgcaacccctgcctcccagtttcaagcaattctcctgcctcagcctcccgagtagctgggattacaggcgtctgccaccacgcctggctaatttttgtgttttttgtagagactggatttcatcatgttggccaggctggtgtcgaactcccgacctcaggtgatccacccacctcggcctcccaaagtgctgggattacagacgtgagccaccgcacccggccttactgtgctttatgagaaataaatacacccctgaagtgctgaggaagtccagacccaaaaaacatgttcttatggacttaaaatttcaggtcaactttttcttaatttccaaaagacaacagtttctaagtttgcctactttagcttttcaagtaaaataaaagatacatagatagatgactagacctctagctgtctgtcggtctctggaacatgtccaaaaccaactcatcatttttccctcagacttgcccctctttttctacttcctctctcaggaatgctgtgtcaccacccaactagaaaaacccatcggaaaccccaaggtcacttaaaatctactcttttcctgattttcgaaaatccaatacattgttgttaactctagtcattatgttgtacaacagatctcttgaactactcctcctaactgaaactttgtacttttgaccaatatctccccaactccccccagcccttgccctggtagccaccattgtgctctctacttccattagttcaacctttttagattccacaaaaattaatttgtgaggtagtgcatatgttaattagctcaatttagccattccacaatgtacacatatttcaaaacagcatgttgtacacaataaatatacacgattcttgtcagtttaaaaattaaaataaatgaaaataaaaattaaaccaaggtcatcgtcactcttcctttccctttggtcactaagtcctgctaattttgcctattaaactatctcaattctactttctcctctttctcctctcctgtgcaatctttccttgggcccttatttctttccttcattgttttagcagcaccataactggtcagctggccctttaatgacttaaagcgccacactgagaaataatcgtctttctaaatggcaaactcgattctatattccatccttatttgagatcttttggtatttattacctaggacttttatgtgagccacacgagtcccattatgatctggctacaaccaacttctctgactcatctctctgtcactctgctccctcccacaaaactcgaactccctacacttctcccatgctgtttcccagcttcgtggcttcacacatgctgattcctctgtctataatgtcctatacttgttttgtctttctgtagaactgcctaagagccgggagaattcatgcttttgaaacaaggggaatttcccttgtccctcttacagggcatgtgatgggagtgtggcccacttcttaggtgccccactgctcaaaacccctagggaaagcaggcagatgggcaggtcgtggggagtgtgggctccaaccccatggcagcgtctaggggtggatgtttacagcttctgcagccccagtgggcgtgtgttacgtgtgctcttttagttttgctgtcagtaggcagcttgtgttcatcagctcagttagaccctctgccttattgcaaggacagagggctttctgtatcctagggttcttgcctgagtataccagaaaaaccggatcacacgtgggcttggaggatgagtgcaaggttttattgaatggtggaagtagcactcagcagatggaaacggagccagaaggggtatggagtgggaaggtggttttcccctggagtcaggccgcttagcagccaggctctcctctgaccgccctcagccaaactccgcgttgtcctgccgttctgctgttggtggcctgccggagtctgtcactgtgttcttctgctggtatgttgttccttgcctctgcttctcttgacgtccagccgcttgtgtgcctgcccgctagggtctcggggtttttataggcacaagatgggagtgtggtgggccagggtggtcttgggaaatacgatatttgggcacaaaaacagaaatgcctgtcctcacctaggttggtgggcacaggcccaggggtggagccctagccagggaccacgcccttctctacccagcatttccctgcctgcccctcccgtatcacttttcttttatttatttactttttgagacagggtctcgctctgttgcccaggctggagtgcagtggcagtatcttggctcactgcaatctccacctcctgggttcaagcgattcttgtgcctcagcctcccttattttattttttaatctgtcccaggccaagtgcagtggttcacacctataatcccagcactttgggaggccgcggtgggtggatcgtttgaatccaggagtttgagaccagcctgggcaacatggcaaaaccctgtctctacaaaaattacaaaaatgagctggacatggtggtgcatgcctgtagtcccagctatttgggagacaagacaggaggagtgcttgaacctgggatgggaaggttgcagtgcagcagaaatcctgctgctgcactccaacctaggcaacagtgtgagaccctgtgtaaaaaaaaaaaaaaaagtttgtccatttatttacatctatcaagttcttcctaccagaatggaagccctttcagggtgaggatatgtcttactccatattcctatttctatggctgtgcctaacacacaaggcatgctcaataattgtttatttcctgctcaaatgagacaaaaggaaatggatggaggagaggtggaaaataaatgagtgattgatttctctctaactatttaggcatgatttagcatcttggaaatcatattactgagatttgcagtgcctgtaatgtgaaagatgaggctattctgtaatacaaaacgtaatgccagctaaaatataacaaaaatatctgttgaaacgtatggctgcaaattcccatatttcagaagcaaataaagagctgaaagccattaagaaaaaaaagggtggttgttactttaactggtttaaaaacaattgatacatcttgaagtattaagtgtgcatcttgaggtcttaatttcaatgcagttttgctacagatttcttttgcttccacgatacagattagccagctagtgctgacattagttcatgtggtttgtgcccatcacaattattaggcagaaccagcagcaccaggatacaacctaaggagatcaacgtccctcctagaaaactgccacggccttcgcaggaggggtctgaatttttttttttttttttttttttttttttgaggtggagtctcgcactgtcacccaggctggagtgcggtggcacaatcttggttcactgcaacctccacctcccaggtgcaggtgattctcctgcttcagccttctgtgtagctgggattacaggtgcccgccaccacgcccagctaattttttttttttttttgtaattttagtagagacgggatttcactatgttggccaggctggtctcgaatgcctgacctggtgatccacccacccgcctctgccttccaaagtgctgggattacaggcgtgagccactgcgtccagcacattttttatattcacaattaaattaataaaccataactctcctcctctcagcccatctttttttttttttttttttttttttttttttagtggagcgattattttgtgtgtgtgaaacagagtctcactctattgcccaggctggagtgtagtggcatgatcatggctcactgaagcctcaaactcaagagttctcccacctcagtctcctgagtagctgggactacaggcacacaccaccatgcctggctgattttttaaaaaaatatattttgtaggccaggtgcactggctcacacctgtaatctcagcactttgggaggccgaggcgggcgaattacctgaagtcgggagttcgagaccagcctggccaacatggcaaatccccatctctactaaaaatacaaaaattagccgggtgtggtggcagacgcctgtaatcccagctacttgggaggctgaggtagaagaatcgcttgaacctgggcgttggaggttgcagtgagctgagatcacgccactacaccgcagcctgggtaacagagcaagactccatcttgaaaacataaaaataaataaaaataaaataaagcacagtaagcctttcagggtggggagtggctgaggttatgaatatgctcatgttctgcacattcggtctgtaacatagagaggtttaagattgcttctgcatttcaggtaattcagaggtccgtggggccagccagcctgagcttgctcaccttcaaagtctatgcagcaccaaaaaaggactcacctcccaaaaattccgtgaaggttgatgaggtaacatgttgttcatgttgcgatatattttgagtgtctgatttagttactgtaggataattttttacaaattgtatatcaggaagatgtgactgtttaaaatacatttatttatttatttatttatttatttatttatttattttgagacggagtttcgctcttgttgcccaggctggagtgcaatggtgcgatctcggctcattgcaacctcctcctcctggttcaagccattctcctgcctcagcctcccaagtagctgggattataggcatgtgccaccacgcctggctaattttgtatttttagtagagacaaggtttcaccatgttggccaggctagtctcgaactcccgacctcaggtgatccacctgcctcggcctcccaaagtgctgggattacaagcgtgagccaccacgcccagccagaagacatttaaacagagaaaatatatttccttatagtttgtttaatttgtgggaaatattaaactatggctttttcaacagataaactttaatgatacttaggtaagggcacaattaaggaatactttataaatgtttactggggaatccactgtgtcccaacaggttataagcacaactcacttttctaagtggtctgcctgattcttggcttatcttgattcttatcgagccaagaatatattcacattttttcctctctaagaaattagagatctggatcctttctgtttcttggctagaggagccgctcataagtatgtacttaataaatactaaatttaaaaaaaaaaaaaacaagaaatcttctctctactgtttacattcctttttggtctgtacttcccactaattattttggatattcagtttctgttgcctttgaataaagtgaggtaaggatctaccttcagtcctgggtagggttactagattggtgtttacataaagctaattagcttatcttttgccctttactcgcttctcaggccttggcacagtggcatttttgagggtaaagaaggcagccagcagtggctgtaagaagttctctgggtggagaataaacctgctgtcctgctttgattaacatcagaccaatcatttgaactgaatgacatgccctttggttactctcaagcttttttaaccccttcacccaccctttagagtaataaaatcttttttccaagctcaatctaaggtggaataccaaataccagtatataaaatggataaagaggagctgctttgtttgtagtcagtgggtggggagaaagtaggacacctcatagccctgcccttttggccttggcctcgttgattatggaaataaggtgcagagatagtttgagataaagttcaggttgcttgtaacccttagagtcactggaattcatgaagtattattattattatttttgagatggagtctcactcttgcctaggcttgagtgcactggcacaatcttggcttactgctacctccacctcccaggttcaagagattctcccgcctcagcctcccaagtagctgggattacaggcgcctaccgcgacacctggctaagttttgtatttttagtagagactgggtttcgccatgttggctaggctggtctcgaactcctgaccttaagtgatccgcctgccctggcttctcaaagtgctgggattacaagcgtgaaccaccacacccgaccacagagtcactgtaattcatgaattactagaaatattatattaaatacttacaaatttgataaatgtatcctgtagacagtacatcttttaaatctttgttttgttttaatgtgcgcagctttcactctactcagttcctgagggtcaatcgaagtatgtggaggaggcaaggagccagcttgaagaaagcatctcacagctccgacactattgcgagccatacacaacctggtgtcaggtacaactgttctgaaaatggagtgaacgcatttctgtttagagtccatagaggaaagtctgtattggctgcatgtttttggaaaaaggcatgataaagggccctgagatggttgacagaggctgggaagggtagtgggggtctgggggaaaggtggggatggctaatgggtgcaaaaaaaaaaaatagcaagtagcaagaatgaataaaacctatttgatagcacaacaggatgactgtagtcaacaataatttaattgtacattttaaaataacttaaagagtgtaattggattgtttttaacactaaggataaatgcttgagcggatagattccgcattctccatattgtgcttatttcacattgcatgcctgtgtcaacacatctcatgtgccccataaatgtatatacctactacgtacccacaaaaaatgttgaaatacaaggccccaagttaaaagtgcctgacttacagatgttcttcagtgccatctgaggaggggttgcagagatgccctagcttcctggtgacagctgttgccacagctacagagagaatttccctctccctgggcagtgcgtaacgccttaactagagagcagaggggctaggaactaccttgttgcttgcagttatgaaaacattgttgtctaccaggggaggcttgtgggctggaactctaaacaaaggaaaaagatgcaacgtaaacacttacataaaaattgcgaagtttttctccccccactatacaaatcagtgccacttaaaccaggaggggatatggcattttgaatgctatactaaaatagggtagaattccatactggattactgaactatttgttctagtgaccaaagaactacatatacagattggtttctgtccctgcctgggttttaggtcaggcatttgtcattacgtaaatgaaaagtatttctgtgatttttaacatcagtaaccaacgtttacaatctatagaatgcttttgtaggctttgatacatatgtttgttgtacttgatcttgattttgaaaattgaaattaataaaaactaatagatgtagatatgtgggaaattgtctagatttaccttgcttgagatttataaatttagtctttttgtttttttttttttttgagagggagtcttgctctgtcgcccaggctggagtgcagtagcgtgctctcagctcactgcaacctccacctcccgggttcaagcagttctcccgcctcagcctcccaagtagctgggattacaggcacgagctaccatgcctggctcatttttgtatttatcgtagaggcagagtttcgccatgttggccaggctgatgtcgaactcctgacctcaagtgatctgtccaccttggcctcccaaagtgctgggattacaggcgtgagccaccatgcctggcctaaattcaattttgatccagagcttgtttaaaaatttttaatttccgttgcctatgctgctgttgaacttttgttcaccaatttagaaagaaaatagtaaagcatggactctatcaacaataagaattaggccattatacttaagtatcataaccatattattgagttaagtaatacctaaagactttaaacataacatgttgtaaaatgattagactttattctcttgttctagaagatttttaaacttctggtagttaagataaagtcagcaaatttgtgtgtatatttttgtatcatgtaggcatgactactgttacttgtagtctgtctgttttttttgtttgtttgtttggtttttttggcaataaaagtactttgtaccttttagcctaaggttgctttttgttttttaccttttcttccatgcgtgatactcagtgcagcaaaatacctctctggatgatggattagttatctatatgtttatttccactactactaaatataaaaacttgcttgtaattataatagtttttgtaattataatggttttgttttcctgggtagaacaaagcctttatgagtagaaatatttctaattcctggttcctttttcagaccagcaatttctagcccttttcttgaagaaccaatttaattttgtttttttgttctttgtttttctttttttgagacggagtctcgctctgttgccaggctggagtgcagtggtgcagtctcagctcactgcaacctccgcctcccgggttcaggtgattctcctgcctcagcttcctgagtggctgggactacaggcgtgtgctaccaagcccagataatttttgtatttttagtagagacggggtttcaccatgttggccaggatggtcttgatctcttgaccttgtgatccgtccacctcggcctcccaaggtgctgggattacaggcatgacccactgtgcccggccttaattttttttaatagtaaaaatattaagctagcaaaagaagtcggcaatcattctagatattgatctgaagttttttcttttttttttttttttttggtagagacaaggtttcaccatgttgcccgggctgatctcgaactcctgggctcaagagatctgcccacctcagcctcccaagtagctcggacatcatacacataccaccatgcccaactaatatttttatttttatttttattttttttatttttttgagacggagtctcgctctgtcccccaggctggagtgcagtggcgcgatctcggctcaccgcaagcaccgcctctgggttcacgccattctcctgcctcagcctcccgagtagctgagactacaggtgcctgccaccacgcccggctaatttttttgtatttctagtagagaccaggtttcactgtgttagccaggatggtctcgatctcctgacttcgtgatccacctgccttggcctcccaaagtgctgggattacagccgtgagccaccgtgcccagcctaatatttttatttttttgtagagatggggtctctgctgtgttgcccaagctggttctcaaattcctgacctcacgagatactcctgtcttagcctcccaaagtgttgggattacaggcgtgaaataatggattttaatgaagcgatactcagttctttagatcttctggctaattcggcatttattatttcaggtcatttaaaagaatgaggatagcttgttctgacttgaactgaattacacaaaacaaatccttttccaggccgggcgcagtagctcacgcctgtaatcccagcagtttgggaggccaaggcaggtggatcacctgaggtcaggagtttgagaccagcctggccaacatagcgaaaccctgtccctaccaaaaatacaaaaattagttgggcgtggtggcgggcacctgtaatcccagctactcgggaggctgaggcaggagtaatcacttgaatccaggaggcggaggttgcagtgagccgaggtcgcgccactgcactccagcctgggcgacaaaagcgaaactctatctcaaaaaaaaaaaaattaattaataaaaataaaaataaaaaaaaaatcctttcccaaatggcaactagttttgataccttctgatacccatgtatctcttcttgtcttcactgtagacttcttgaaggtgggtaccttctagcgggtccctcgtttcctttaggatcatgtgatattcatgtacaaagccttttttttttttgagacacgcccaggctggagtgcagtggcgccatctcggctcactgcaacctccgcctcctggattgaagtgattctcctgcctcagcctcccgagtagctgggactacaggcgcgtgccaccacgcccggctaatttttgtatttttagtagagacagggtttcaccatgttggtcaggctggtctccaactcctgacctcaggtgatctgccccactcggcctcccaaagtgctgggattacaggagtgagccatcatgcctggccacaaagcctttttattgtttttaagagaatgttgacacctcatttgctttgggctatagcctttgtctcattaaagctggtcattcttgcttcaaatgggcagtttccagatgtaggctctaattaatggcagatcaggaagtagttaatatgaaagacaggtttaatctcatggagaaaagcttgccacttaaatatcaaggggattgatttttagtctattttttccattttaatggaagagtgaaatggctggattgttgaaaccactctgtttggaatctgcttcctgtggcagtagtaagccattctgctgagtaatttgcagtgaagggaagattataataggaaaaacaaacaaaaagacccagacagacagtgtatccctttgttcaaaaagcgttaataacatgataatttattcagtaaaaacaagtatatttattctgttaactttctaatcagcagatcctgtgaatagtttcattcagtttctttttacctttttaggaaacgtactcccaaactaagcccaagatgcaaagtttggttcaatgggggttaggtaagttgattttaaattaggcataatcagctacttcattaacattgaactctttaatcggagttccatgaatgagctccaagaaatctgtgtattccttaaaattatatgcagaattttagagctatgtggatttttctgggaagaggagctgttgttttcatcagatttcaggcaactagtgtccccaaatagtcaggtaagtctcttcaagatcgttaggattcttgggctagcaagtacagatacactgctttaaaaaaaagaaatctcatttctaggtgcagcgtaatacaccatactaattcatcaatagattttctgaatcggaatagctcatttgcattgcaattaatagatgctctagaagttttgaagcaggaaggagctgagttggtactcctataaaaggtcttactgcataattgatagtgttcttacttttttttcatttggttttattttccttgattatttttcagttgtgggccacttatcacatacactcacaaactggattcacagtccatgttctgactaatcttaatcagaaactggtaaattaataaagataccgatcatatttcattccccttattaggcatctcgcaaacaaaatcttgtttttacaagggtttgtttccatgatagaacaaaataaacataagtacagtttctttggtaagatcaccatggtgtattgatgtcctgatatttctgagactgtcagataaatttatcgtttgaagacaaacataacaatagctgcctactggttttttgtttttttttttttgagacaaaatatcactctgtcacccaggctagagtgcagtggcatagtctcagctcactgatacctttgtctctcaggttcaagcgattctcccaccttagcttcccgagtagctaggattacaagcgtgtgccaccacatccacctagtttttgtatttttagtagagacagggtttcaccttgttagccgggctggtctcaaactcctgacctcaagtgatctgcccgcctcggcccaaaatattgggattacaggcgtgagccaccgtacctggccccctactggttctttaaattattaaggcatgttaataagtaacatcttaattttattaatttcataaacacttatttaagacttatatgtcaggtactattctaagtgctttacaaataccaatttattgggggtggagtgaggatggttaatgagtacaaaaatatagttagaatgaataagacctagtatttgatagcacagtagggtgactgcagtcaataatactttattatacattttattttttattattttatttattttttatttttttgagacagattctcactctgttgcccaggctggagtgcagtggtgctatcttggctcactgcaacctctgcctcccaggttcaagcaattctcctgtctcagcctcccgagtagctaggactgcaggcacacgccaccacacccagcctattttttgtatttttagtagagacgggtttcaccatattggtcaggctggtgtagaactcctgacctcaggcgatccacccacctcagccccccaaagtgctgggattacaggtgtgagccaccgcgcctagcttattgtacattttaaataactaaaaaagctatactcttttaggtattgtaaataaactgaaagagtataattgggatgcttgtaacacaaagaaaaatgataaatgcttgaggtaaaggatacttcatttaccctgatgtgattattatgcattgtatgcctgaaccaaaatacctcatttaccccgtaaatatatacacctactatgtacccacaaaaattttatatatatatatatatatatataaattctcataacaagctgacagataccttattatcttcatttttatccgaggaaactagagaactcctgatatagtcttttatctgtccatgtgtggctgagaggtctcttgtttaaatttttctgagacaggatctttctctgtcatccaggctggaatccagtggcgtgatcatagctcactgcagcctcaacctcctgggctcaagcaatccttccagctcagcctcccgagtagctaggattacaggcatgtgccatcacattttttccactttttgtagaggcagggtctcacttttttgcccagactccgtacagtcttaaaacatatcttctttcccctttctttgtgatttacccactttggcccagctcaccagagccatctgggtgtccctctgtcaactgctctgtgtacacatctagaattgagcaacactgggctagtaggcaaaaataaagggaagtaaaaaattgcctcaaatgacccagactagaggatggaaagtaaaaactaggctaaaggcaaaataagtaacaggccagacagtaattaatgcaaacataatacaagtcctatagtagtatttaaaatgatcacatttcccaaagaacccaggaaaaggaaaactggcgtgtatctggtattacttaggggacagaattgctgagttttccagtttattagttcagttctgtatatattttttaagtcaccattctgccaggcctcgaaaattgagattggttaagacagtggtcacaaccactgagatgcgtgtaatatattattcagtactagtgcaaatacagagataatcacagaccattattgaaggtacagaggaaggagattagtttaattgaaatcgaggaggtgggagcagtcagggaaggacttctgaagtgaatcttgaaggagcagtgttagccactccaaaatgtgggggtgggactgctggaagcaggcattgcacactgggcccagcatgatcaggcttagaggtgtgacttggtattggatgtttgaggaaccctaagtagatagggagtgctgaagatgagattgagaaggagacatgagggctttgtgtaagtcatgacctagctaaaattcatttgttaattcatccagtatttttttttttttttttttgagacggagtcttgctctgtcgcacaggctggagtgcagtggcgcggtctcggctcactacaagctccgcctcctgggtttacgccattctcctgcctcagcctcccgagtagctgggactacaggcgcctgccaccacacctggctaattttttttttttttttggtatttttagtagagttggggtttcaccatgttagccaggatggaatacatccagtatttatcaactcctggcagtgtgatttttgtttttttgtttttttgttttttgagacagagtctcgctctgttgcccaggctggagtgcaatggtgtgatctcggctcactgcaacctctgcctcccaggttcaagcgattctcctgcctcagcctcctgagtagctgggattacaggcacacgccaccacgcctggctaatttttgtatttttagtagagacggggtttcaccatgttggtcaagctggtctcgaattcctgaccttgtgatctgcctgcatcggcctcccaaagtgctgggattacaggcgtgaaccactgcgcctggcctgtttttgtttttgtttggagacagggtctcattcagtcacctaggctggagtgtagtggcatgatcatagctcattgcagtcttgacttcctggactcaagcaatcctcccacctcagcctcccaagtagctgggaccacagacatgcatcaccacacctggctaatttttttttttaattttttgtagagacagggtttcgccatgttgcccaggctgttcttgaactcctggactcaagcaatcctcccaccttggcctcccaaagtgctgggattacaggcgtgaaccactacacccagccatcattcttaataaatatctattgaatgaacatccattattaccactgagggaagataacacagaagtgtaagcaatctatcattaaggagcttacattctccttggggagacaccagatatacacctgaataattaaacacagggtactataggattaggtaccaagtgatggtacagagaataaatatgatgggactttagaggagggagagaggtgtgaactgatgagcttaggaaaggcttttgtgtggaagtaggactcaacttggcttttatgaggtgggattggctcagtggagaggagacgaggcattatgtgaatgaagtcagaaggcatgttcagtcatgatgaataggtcacatgttgtatttatttttattctatcaccatcaacagcgatcaacagtggctattttctgagtgaaattacaagtttcctttattatccaaatttattctgttcttctgttcgagtaatgagttcagatggcaaaggatgcttatttttctgagtctaatgtatttgatttctttcttttttttttttttgagaaggagtctcgctctgtcacccatgctggagtgcagtggcgcgatcttggctcactgcaacctccacctctcgggttcaaatgattctcctgcctcagcctcctgagtagctgggattacaggagcgtgccaccacgcccagctaatttttttgtatttttagtagagatggggttttaccatgttggtcaggctggtctcgaactcctgacctcgtgatccgccctcctcggcctcccaaagtgctgggattacaggagtgagccaccgcacctggccttcctttttttttttttttttttttttttctttttaagaggctgtgtcttgctctgtggctcaggctgtcaggctgtcaggctggagtgcagtggctcaatcctagctcaccgcagccttgaactcctgggctcaaatgattcttctgccttagccttggaaagtgctgagtttataggaatgagccaccactcacagcttgtttttggttcctgagtttcagagagcaagcagcaaagcttcagatagcaatagatctatccaaagatttatccaaatctattctgtttttgtgtttccataacaagagtttgaatagcaaaggatccctgtatttgtattcctccctgtgcaaattgctgattcagatctgttgctttcaggaatatgaaagtaatttaacatttacttcattgtcagtaggttgttggaccaaaggtacttgaaaattggacacttgcagccgggcgcagtggctcacacctgtaatcccagcactttgggaggctaaggcgggtagatcacctgaggtcaggagttcgagaccagcctggccaacatggtgaaaccccatctctactaaaaatacaaaagttagctgggcgtggtggcgggcgcttgtaatcccagctacttgggaggctgaggcaggagaattgcttgaacctgggaggcagaggttgcagtgagccgagatcacgccattgcacaccagcctgggcgacaagagcaaaacttcatctcaaaaaaaaaaaaaaagaaagaaaagaaaattggacacttgctatgtgaatagtaaatcttgtttatatgtcacataaaaagagtatgttgaagagaagtatagtagcaggatgcagagaatatgtggtttgaaaagcacttgatactatatatacatattatatactgtataagacttttgttttgttttttaatgagaaatttatggaactgcttcctggtctaattctattgtagacagctatgactatctccaaaatgcacctcctggattttttccgagacttggtgttattggttttgctggccttattggactccttttggctagaggtaggtgcaattttatggctttaacagtcagctcataaagcagagatagaatatatgtttcattctttcccttcatttaccaggtttcagaataatgagttggttcctaaatacggctttcttaatgtataatggatatggttatcatatttgattttaaacataaatagaaattgtatactcttggtaaaaaaaagaagttatcctttataggcacatttacttgatcaaatctctgttgttctttggtacagaaagagcaaaattttaaagtctttcacacctgagaaatcaactgtttctaaacgtttcactattaagatcaagctatattaatcacagtagatagagcagtgatttaatagagattttattaccttcttgatttgtcatgccttcagtcagtgatgacaaaaactttaaaaatgctttaaatactaacaaatgccaacttaaaaatattactatactgctagattataaaatatctataggaaataaaggctaataaaatactttgctatgatgagatgaatttgttatcaactacttgaagttttgctagttggaaactaaatgtttatgatataaaattctgacattaccatcattcctaatgaagaaagtttatgaatcctgtaatcagacccctgtaaaagagaaccatagagactactctggtccctgtattagtttgttttgcattgctataaaggaatatctgaggctgggtaattataaagaaaagagatgccaggcgcagtggctcacgcctgtaatcccagcactttgggaggccgaggcaggtggatcacaaggtcaggagatcgagaccatcctggctaacacggtgaaaccccgtctctactaaaaatgcaaaaaattagccgggtgtggtggcaggtgtctgtagtcccagctactcgggaggctgaggcaggagaacggtgtgaacctgggagacggggcttgcagtgagctgagttcgagccactgcacttcagcctgggcgacagtgcgagactccgtctcaaaagaaaaaaaaaagaggtttatttggcttatggttctgcaagctgtacaagaagcgtggcatcagcatctatttctgttgagggtttcagaaagcttccaatcgtggtggaaggcaaagggggagcaggcgcatcacatggtgagagagggagctagagagatgccaggctcttttaaacaaccagccctcatgttaactaatagagtgagaaatcactcattcccacagggagggcaccaagccattcatgagggatccacccccatgacccaaacacctcccagcgtgggggttcacatttcaacatgagatttaaaggggacaatcattcaaactgtatcagtcctattcctccaatttaaaaaatcttccctctacatgcaatagcttttactttagtttagtttagtttcgtttcgtttcgtttcgtttcgtttcgtttcgtttagcttaatttgagatagagtctcactctgtcgcccaggctggagtgcagtggcacaatctcggctcactgcaccctccgcctcctgggttcaagtgattctcctgcctcagcctcccaaatagctgggattatagatgtgcaccaccacgcccaactaatttttgtatttttagtagagatggggtttcgccatgttagccaggctggtctccagctcctgacctcaagtgatcggcctgcctcggtgtcccaaagtgctgggattacaggtgtgagccactacacctggccttattttttttttaattgatttcttttttgagacagggtctcactctgtcacccaggctggagtgaagtggtgtgatcatagctcattgcagcctggacctcctgggctcaagtgatcctctcaccttagcctttcaagtagctgggattacaggcgcctgccaccatgcccaggtaatttttgtatttttagtagagacggagtttcgctatgttgctcaggctgaactcctgaactcttgaactcttgaactcctgaactcaagccatccacctcccttggtgtcccccaaagtgctgggattataggcatgagctgccgcacccagctaatggctgttatttttgaatctggagggtagacactgccctggtggcactaccagctcacctgtggaagcaactcatgtcacagtctttgtgccctcctcccatctcatgcagaatatgtcagaattaaatttccagcttatttttgtaatcaacttatgaaccaacatttttccctaaacttctttcacctcatttcttgcaaagctgttcagaagagcattcggtcttatttagatagcgtttgagattgatgaacatcccaaggccagggtgttgggatttcagctatcgttagggagataggaatgtagaagtgagtgagaggagcttccccctccctctcctggttagagcatgtgggaaaatcttccaggtccaaagaaagcactttttctgtgctgtgggtacgttcctacagtgccgagagcttgtccctggaacatccactaggatgaccatcctaaggaggattggagatggtgctctcctggccagagcagcagcatgaggacatctgctacagtgggtcctagtcctctgattttgtttgttcgttctgtctcttttcttccttttcctggggagagcttggtagtattaaaataatttgacaccttaattctttttcacaaatattcacacaggcacgcacacacacatgtgcaatagcaggtcttttctcctgagcgttgggtatagaaagacctgaggtgagcagcatcagaggggttcaccaagcaagatgagtggggtgatagggatgtctgtgggtagccagaatggtttgcaggcccctccaggtgaatgggcccctttgagggcagcagcagggtgggtgggtgcagaaggtccctcctgataggagtttcttttttttttttttgagacagtcttgctctgttgccgagactggagtgcagtggcgccatctcagcctcactgcaaccctgcctcctgggttcgggtgattctcctgcctcagcctcccgagtagctgggactacaggcgtgcaccaccatgcccagctcatttttgtatttttagtagacacgaggtttcaccatgttgaccaggcttgtctcgaactcctgacctcaagtgatcctcccacctcagcctcccaaagtgctgggatcatagttgtgagccactgtgcctggcctggtggggtttcttgagcgtatctgctaaggtagtctgcttcagttgttgaggattgccacaactgtggtggtgacaagaggctctcagagaggtgaatggatgtccattcagaggaagtgggcccagccagaccactccaagatgacacgtggttgttgacactattgttgccttctggtggctctccccagcattggccaccagtggttccccccgcccctggcagtgctgatagtgacaacctgtaccactggcctcttgggagatagggcatggaggtgggggcaggggagtatgattacacctccttcctgaagttcttgggtctctggctcattgtgtgaaccagcaggagctggaggcccgagagctgccacttctcggctctccctggaggagtgagaaatgactgggtggcaggttggctgctctttccctggtcctcacttgggtgagctgcttcaagtggatgggggcaggggaggggccatatgcagggatatcacaggcttttctcttctaggataattataccctttcaattcatgcaacaggatcaggagagaaacagtaaatcattaatagtctaggttgataacatttgtattctcttcagcagtcccagttccatcgttggggatttctctgtttaaagttttaaagccaataaacagtacttatgtgattagaaccgtttaaggattaatgtacacattctgtcggggtacagtggctcacacctgtaatcccagcacttcagaagttcaaggcggatgtatcacctgaggtcaggagttcaagactagcctagccaacatggtgaaacccgtctctactaaaaatacaaacattagccaggcgtggtggcgggtgcctgtaatcccagctacttgggaggcgaaagcaggagaatcacttgaacccgggaggcagaggttgcagcaagccgagatcgcaccactgcactccagcctgagcaacagagcgagaccccatctcaaaacaaacaaacaaacaaacaaatcagccgggtatggtggctaacacctgtaatcccagcactttgggaggctgaggtgggtggatcacctgaggtcaggagttcgagaccagactgaccaacatagtgaaaccctgtctctactaaaaatacaaaattatttgggcatggtggcgcatacctgtaatcccagattcttgggaggctgaggcaggagaatcacttgaacccaagaggtggagattgcagtgagccgagattgcaccattgcactccagcctgggcagcaagagcaaaactccatctcaaaaaaaaaaaaaaaaatcaataacacacacattctgctagcatctatatgggtcccacagcaaaaaacactatgcctctcagtggagtcaaggccatgtgtattctctagtttcatcctctactggtttttttaacctcattctcaggtttctccaggctctgtgtcctgctgtctcttctgtccatttcccttgctccacagctctatatcctcctacaatctggcctgagacttcaacacagttcttgttttgggactggtcttcttcacactttcttgggtttaagcccccttttcctgggttccatgtcatcttctccttggtttactctgccgtgctgttgaactacatgcttaagtcactttcaaaaaagcgtatgttggaggtaaacttcccaagaccttccatgtctgaaaatcactttctgccctcataccatgtgacagtttggttgggcactgaattttgtttgccatcaaaactttcaaagccatgtattctagcatctggcgttgtagatgtgagagtcagtagccattctggatatttgctgcttctgaacaggtgatacattttttttttcttcctggaagctttgaagatcttctgtgaatctttagtgttctgaatttctttggtgctgtgactagatagaagtcttttctttttttttgagacggagtctcactctgtcacccaggctggagtgcagtgtcacaatctccgctcactgcaacctcctccacctctgggttcaagtgattctcacgcctcaacctcccagttagctgggattacaggcgtgcaccaccacgcctggctaatttttgtggttttagtagagatggggtttcaccatgttggccaggctggtcttgaactcctgacctccagtgatccacccgcctcagcctcccaaagtgctgggattacaggcatgagccaccatgcccagccttggatatagtgttttcattcttgcccaaacaatatggcggcttgcagcatccagctgaaggaaaatatcttcttttcctccctccctccctccttctcccttccctgccctcccctccctctctccccttccctccttctccctccccttccctcctccctccccttccatcccctgcatccctccctcccctccctccttctcccttcccttccctccttcttccttcccttctcgtcccgtccctttctcttctcttctcttctcttttctttctgagagatgatctcactctgtcacccaggttgtagtgcagtggcatgatcagggctcactgcagtcttgacctcctcaggctcaagcaatcctcccatctcagcctcctgagtagctgcgactataggcatgcaccaccacacctgactaatttttttttttgtggagaccgggtgtcaccatgttgcccaggctggtctcaaactcccgagctcaagcagtcttccttcttcagcctcccaaagcgctaggattataggcatgagccactgcgcccagcctatcttgtgtatctttgaaaatttactctcattctttttccttcctcaacgcattaattagcaattgagttatttaaaaggaccctatgtgtctcttatattttcttgattattttattttgttccttttgaattttttttgctttggtcatttccaagagctccttcctgttctttgaatgttctttttttcatagaattatttttttcttttaatgtagtggcttttaaaatttatttgatgatacttagtaataggtttagttttgttttgaagttcttctgtttcctttgtgcttgtcttggtctttctcctttatgtttcaggctttccacaaatgactggtgattcttggttatccagtcatgtttcaaagtgaggcagctgaaatgctaataagaactctttcacctgtaatcccagcactttgggaggctgaggcaggcggatcacctgaggtcaggagttcaagaccagcctggccaacatgggaaaaccccatctctactaaaaatacaaaaaatagccgggtgtggtggagggtgtctgtaatcctagctactcaggaggctgaggctagagaatcacttgaacccaggaggcagaggttgcagtgagctgagatcacgccactgcactccaacctgagcaacagagcaagactccgtctcgggaaaaaaaaaaaaaaaaaaaaaagaactccctgtctgtacatggggcccactgacgggcaggttctacctcaggggagctgggcaggaagtgaccatatacaagggtgcacccagggccagtgtgaggagggcttttctctcaggcactgacatactcaccccttccagctctcttggttctcagcaggaaatccatggtgtttctttagtgataccctgcccccactgttttaactcttttttttttttttttttttttgagacaggatcttgctttatcacccaatgtgttaggccattcttgcattgctataacctaacactgggtaatttataaagaaaagaggtttagttggctcacagttctgcaggctgtacaggaagcatggcaccagcatctcctcggcttctggtgaggccttgggctgcttgcaatcatggtggaaggcaaagggggagctggtgtctcacatggcaagagtgcgagcaagagaaagaggtgggggaggtgtcacacatttttaaacaaccagatctcaagagaactcactgttgcacaaggacagcaccaagggaatggtgttaaaccatctgtgagaaatccaccttcatgatcaggtcacgtcccaccaggccccacctccaacattggggattacaatttaacatgagattcagagagaacaacatccaaattatcacccaggctggagtgcagtggcatagacacagctcacagtagccttgaactcctgggctcaagcaatcctccagcctcagcctcctgagtagctaggaccacaggcacatgccaccacaccttactaattttttaattttttgtagagatgtggtctccctaagttgcccaggctggtctcaaactcctgggctcaatcagtcctcccacctcagcctcccaaagtgctgggattacaggtgtgagccactgcatcaggctcattttttttttttttttaaaggaatagagatggggggctgggcgtactggctcatgcctgtgatcccagcactttgggaggctgaggcaggtggattgcttgagctcaggagttcaagaccaacctgggcaacatgaggaaaccccgtgtctacaaaaactacagaaaaaaaaaaaattagccaggcatgatggcttgcacctcttgtcccacctacttgaggggctgaggcaggaagatagtttgaacctgggaggtcgaggctgcagtgagccatgattgtgccactgcactccagcctgggagaccgagtgaggccctctctcaacagaaaaaaaagaaatggagatggagtctcgctatgttactccagctggtctcaattcctggcctcaagcaatccttatgcctcgacctccccaagtgctaggattacaggtgtgagccaccacacccagtaaccctggtttactgggttttttaacattttgaactggtgtgacttcctggccaggggtagttttgtactgggatggcataggggaaggaaaggccatgctggtccatgcatcggacttgcgtttgtcctgtgcccttgtcttgctccctggttgccatctccactccccatggtacctgccatctctggatctggaatctccctggggctgcctgggacagatctgctccctctgaggctgcactcctcctcaagatttcaagatttcaaggcagtgtgtcctcttatttccgttcactctccattttctgaaaattgattgacacttcctttctgccagtggcccttccacacattttctcttcattgtgggtttattaatgttttttcttactgtttttttaacggggttgcagaaaggggagaagaagaacgcttgtgtttagtatttatataggaagccagattgctataaaagaacataaaccctagaaaccaaaatactcatttgtttatttttaaaataatctttttttctgctctcttagggaaaaaaaggtgttcttttgaaaacacttggtgctgagtgaaagaagccagtcacaaaggaccgtatatttactgcatgattccatttatatgaaatacccagagggccgggcgcagcggcttacacctgtaatcccagcactttgggaggccgtggcgggtggatcacctgaggtcaggagttcgagaccagcctggccagcatggcgaaaccccatgcctactaaaaatacaaaattagccgggcatggtggcgtgtgcctgtaaccccagctactcgagaggctgaggcaagagaattgcctgaacccgagaggcagaggttgcagtgagccaagattgcgccattgcactccagcctgggtgacaagagcaaaactctgtctcaaaaaaaaaaaaaagaaatatccagagtaggcaaacacatagagatagaaagtagatcaatggttgcctagggctggacggtacgggggagttgaggaatgactgctaatgggtttcttttagtgattatgaaaaagctctaaagttaattgtaatgatggttacacacctctgtcaatatactaaaagccattgaactgtactttaaatgggtgaatatgaattttatctcaataaagcagtgcaaaagcgttttggtgcacatgactttatttggcacattctttcagtttaggaccaaagaaatcttattcagtggtggggttattttggttttgttgtttgggtttcttaagagacacggtcttgctctgtcacccaggctggagtttagaggtgtgatcatagctcattgtaacctcgaactcctgggatcaaggaatcctcccacctcagcctcccaagtagctaggactataggcacacactaccacgcctggctaatttttttattttaatctttgtagagacaggatctgactatgttgcccaggctggtgtcaaactcctggcctcaagtgatcctcccgcctcggcctcccagagcttttggattataggcgtgagccactgtgcctggccttgttccgtattaaatggataaggtaaattgtgatggtgaggataatgaatcatctgatggcgtgtacaaccttttatttatcaggttcaaaaataaagaagctagtgtatccgcctggtttcatgggattagctgcctccctctattatccacaacaagccatcgtgtttgcccaggtaagagaaactctgtaatccatgatgtccctcattcttgtttgtgtgtgtatgaatctgatgcttaattttattttattttgcagttcttataacaccagactaaaatttgtttgtacatatagatgaatacagaaaatttaaatgattttctccactatatgcctcagttctggcccttcttccagtaatgccagtgttcacagaatttgaacacgaatttgcgtgattgtttgaatgttcatcagcaaaaatttaatatacattttttgtatacttacatggaagtctagagactcaaattccaaagctgataattatgggtcactcagtttatgcatgtccggtcacaacctgctctcgttggtattgtagacccagactactctgacttccactcctccctagtactggtgcccttgctttccttgctggggactttggggactgtaatcccctctgcttggagtgcccttttcggggctttcagttggctgctcctttcttatccttgaagcctcagtcttatggtaccctggcaagcaggtctatcacggtggcaggcaacatggataaagctgtaccaccgattcttaaaatgtgttaccagaccagaagcagcagcatcacctgagaacttgttagaaatgcaaactctcaggccccaccccagactgactgaatcagaagctctgggagtaagggccagcagtctgtgttttagcaagccctccggtggtttgttattaatgcctatggtgtttgagaaccactgatggagaccagtaggtagcctgaaaagggtgatatctggagtgagtgggactctagagatggtgtccctcaggaactggtaagaacaagacaggctctaggttttgaggtcctgggcagattgtggacacagggactttagctgctggaactaccacatcacatggaaactcagttccaggagcagacagcagtgcagtcacccaaattggactctgagccagactgacctgagactgagcttccttggttgttcatgacagtattgaatccagattccttgattgggctacagttgtatgtgagagtccagtggccccagcttggggagcttgatggctttgatgacaaataccagtactttccagcatttgctcaacattgtttgtaacagtcctggaggcagatagttaatgcttctgtccctgctccagccccaggtcaggaacagtgagtaacatcttccagccctagatataaaaataattaaacattatttcagcctgttatggtttaagcagtaaatagctagagtggagagggtgaacttggttgctcgttgagaagcatatgtggctgtccccagagtaggagtcttttttttttttttttaaatttctttcttttttaacttttagcgttaggtgtacatgtgcaggtttgttattgtaaatcgtgtgtcatgagggtttggtgtacagattattttgttacccgggtaataagcctagtacctgatgggtagttttttgatcctcgccctcttctcaccctccaccctcaagtaggcctcggtctctgttcccttctttgtgtccatgtgttgtcaaggtttagttcccaattacaagtaagaacatgtggtatttggttttctgttcctatgttagttcacttaagataatggcccccagctccatccctgtccctgcaaaggacatgagctcattctttttggctgcatagtattctgtggtgtataagtaccacattttctttatcaagtctaccattggctgggcatgttggcccacgcctgtaatcccagcactttggaaggccgaggtaggtggatcacctgaggccaggagttcgagaccagcctgaccaatgtggtgaaaccctgtctctactaaatacaaaaaattagctgggtgtggtggcacatgcctgtaatcccaactacttgggaggctgaggcaagaaaattgcttgaacccaggaggcagaggttgcagtgagccaagattgcgccattccactccagcctgggcaacaagagcgaaaactccatctcaaaaaaaaaaaaaaaatctaccattgatgggcatttaggttgattccatgttttgctattatgcatagtgctatgatgaacatatgcatgcatatatctttatagtaaaatgatttatattccattattattcccaataatagggattgctgggtcagatggtaagatcttttctattttgttttaaggtcagtggggagagattatatgactggggtttacgaggatatatagtcatagaagatttgtggaaggagaactttcaaaaggtgaggagcatctttttcattatcttccttttggtttaaatatgtggtttctctagggttttgtaaaatatttgataaccctgttgatttattgctttttctgtttgcttctagttctgtctccagctcagatttttcaggtgacctttcttggtagagcagtagaacttctgagtatttggttattatcagcagggccaaataagtggtgaccataaaatgcaatgcattccaccgtagtcttagaccatattttccattatattgtattcctagtttcctctaagtgtagcgtattatttaaaagtcttattgaaactgaattcaaagggaatgtactatgctcccaggaaaaagacataattgagagcctcttcctcttggtttttcacttatcatgagttctgttctttccttagcactgctgtttctgtttatcccccaggcttctcagctcagctgagggtgtgagccatcgtatgttggggactagctaccagctaaaggccacgttctctgtgctgtctagtacatgagcaacagagggaagaagttgtgtaattgtaagaacttgtcacctttcatctcttttagtggccacatagccgattaaatgttgcctatgttcgcttggaacattcccttcctcccactgataaggaagaatgagtagagaataaggtatcatgtctctactaagcactcagaggcacagccagctaaggaagaattagacttcttatattaatataccttctacatcacagattgaaggaagttcatttttcaatgaaaatactttttaaaaaaaaataaataactgagcttcaaatcattgacaagttaaaaaaatacatataaataactatctcagaattaaaatccagaattttgaactgggatttggaagtaacagaataaattataagccctctttattatttacataaataatcttctagtgaaatcttaagactcattttttggccaggtgcagtgactcacgcccagcacattgggagtccaaggtgggaggatcacttgagctcaggagtttgagaccagcctaggcaacatagtgagaccctatctctccaaaaaataaaaaatttagctgggcatggtggcatactttgggaggctgaggtgggaggattgcttgagcccagaaggtaagggctaaatagagtgagccatgattgcgccactgcactccagcttgagcaacacagtgaggccctgtctcaaaaaaaaaaaaaaagaaaaaaagaaaaaaaaccccactaatttttatactggtggtttctaaaggaattagtccttctcgagcctatttaaactagctcttgaataggaaattctataccaatatcaagagtcttttggcaatccctgtttttttgattgttttttgttttatttctctgatattttctatggaagcttcctttcctttttaaaaaattccttaacaaatgcggccaggtgcggtggctcatgcctgtaatcccagcactttgggaggccgaggcgggtggagcacctgaggtcgggagttccagaccagcctggccaacatgatgaaaccctgtctctactaaaaaaatacaaaaattagctgggcatggtgatgcacgtctgtaatcccggctactcaggaggctgaggcaggagaattgcttgaacccaggaggcagaggttgcagtcagccaagattgcgccactgtactctagcctgggcaacagagcgagacttcatctcaaaaaaacaaaaacaaacaagcaaaaaaacaaatgcacactaaattttatatgggaaaggaagtaaaatatcaagaaatctctaaacagccctagacagaaatgtggaaagtgagactaaaagcctcaactgcgagccttcattgtggtgtgactgcagactgaagcacaccaaagccagagggagtcccccaggctccccggagtgctcactgtggtgtctgtgcagacacacacgcacaccaaagctaaagtgagggctgcgggagcctctggcttggaaacagcattctctgactgtgctaagaattcagcccagtgcagaagcagctggactgtggttaggataccagttaagcaggccaacattttctggtcatttgaagacattagatattaaagctacccaaatttatatgcagatctttttagagtgaggtggtaaagatttttaattagctcatgattggtttgcatttctctctgtctttatacccttgccttcttcagagtcattgagaacttaaggctttctcctgtttgttactctccaaggataattttattgacagctgtctgttctcaatagaaggtaataaaatcagggccaggcacagtggctcatgcctgaaatcccagcactttgggaggctgaggcaggcaaatcgctttgagcctaggtgttcgagaccagcttgggcaatatggcaaaaccctgtctctacaaaaactaccaaaaaaaaaataataaccaggtgtggtggcatgcacctgtagtcccatctacttgggaggctgaggcaggagaatctcatgagcccaggaggtagagtttgtggtgagccatgttcaccccactgcactccagcctggtgaatgggagtgaaaccctgtatcaaaaacaaacaaacaaacaaacaaaaaaaaaaaacggtcgggctcggtggctcatgcctgtaatcctagaattttgggaggccgaggtgggcggatcacgaggtcaggagatcgagaccatcctagctaacacggtgaaacctcatctctactaaaaatacaaaaaattaatgttgactgcattaaatatttattacaagttttaaaggaaaaatagcagaaggccctattaattcaaaattcaatattcttaaatttcaggaattacttgatataatgaagtggcattgttttttgttgatcttgcttcaccccccccactttagatttcatgggcttcagggggatttttgttttttattttttggtttatttatttatttttgagatggaatcttgctctgttgcccaggctggagtgcagtggcacgatctcggcttactgcaacctccacctcccgggttcaagccattctcctgtctcaacctcctgagtagctgggactacaggcgcacaccacaacacccagctaatttttgtatttttagtagagacgggttttcaccatgttggtcaggctggcctcgaactcctgaactcaggtgctccacccatctcggcctcccaaagtgctgggattacaggcgtgagccaccacgcccggccttgtttttgtttttttaatgagagctaagatttaagctaccctggaaaatgaatctttctggggccttggagctgagtatattctcttcatagactatcaaataattcaaaatctagtaaaggagataaggaaagcatatgaccaaaatacaagataaaatgtgataaatgccagaagaaaggcacacacaaaaatgtatgatttttggatgaagatatcttgtcttcattgaagggaattaagggacgcttcatgaaggggacttttttgtttcttagcttgttaggaagttggttttcaagtccagctttaattaccagtctcaattaagtatcatctaattcatattttttttttttttgagacagagtctcgctctgtggcccaggctggagcgcagtggcacgatctcggctcactgcaacctccgcctcccgggttcaagcgattctcctgcctcagcctcacgagtagctgggattacaggtacatagtaccacgcctggctaatttttaatagagacggggtttagtatttttagtagagatggggtttcaccatgttgtgcagggtggtcttgatctcctgacctcgtgatctgcccgcctcggcctcccaaagtgctgggattacaggcttgagccaccgtgcccggccaattgtttgtattctaatcatgtaacagatgtactggcttttggttgtacatagtcagagaaactgtggacactatgtttaaaacagggtgctggccaggtgtggtggctcacgcctgtaatcccagcactttgggatgtggagacgggtggatcacttgagcccagaagtttgagaccagcctggacaacatggcgcacccccgtctctactgaaaacacaaaaattagccaggcatggtggcacacacctgtaatcccacctacttgggaggcggaggcacaagaatcacttgaacctgagaggcggaggttacagtgagctgagatcgtgccactgcactccagcctgggcgaaagagcgagactcggtctctaaatacatacatacatacataaaacagggcactgaaaatttttaaattaggaatgatggcacaattcttaacggtattatttcccatgggggtatattactctgaaatatcccaaacaggtctgtggcattttgctgctctgccacatcccttttccctcttacgaaatgattctaaatgtttgtgctgagtcttctaccaataaagtagtgtttcagtctgtcatcattggttacttaagaggaatttatctgcttcagttaaaatgaactttttgtcagaactatgaagcaaagataggtgtgtccagaaatattgtcatcttggtacagtctagggctttcttttaagttacaagaatatataacatatgtatagtttaaaatccaacactataatgaccatgtacataccaaccaattatctacctttaaaactaggaaattaccgtggggcgcggtggctcacgcctgtaatcccagcactgtgggaggccgaggcaggtggatgacgaggtcaggagttcaagaccagcctggccaagatggtgaaaacccgtctctactaaaaataccaaaaaattagccaggcatggtggcaggtgcctgtaatcccagctactcgggaggctgaggcagagaattgcttgaacctgggaggtggaggttacagtgagccaagatcgcgccactgcactccagcctgcgcgacagaacaagactccatctcaaaaaaaaaaaaggaaattaccgatgcctttcaagtcttccatgggtcccctcacccccaagtctccccagagggaaccattatctggaattttatttcattcccttgtttttctttaaacttttcttccagtttaaccatatatgtctgtattctgaaatactattgttgagcctgcctgtttttgcctttataaaaatataccaaatttaagtctaaatatacatattatatatatataagtttatctagatgagtcttactacatattattttgcaacttgttttgttcccttaacattttgtttatgggttatgtatggcagtagtgtattcatcttcactgctgtagactattttctttgtgttgttgttgttgttttaatagacggagtctcactctgttgctcaggctggagtgtagtggtgcagtcatgactcactgcaacttccgcctgctgggttcaagcaattctcctgcctcagcctccagagtagctaggactacaggcatgcgccaccatccctggctaatttttgtatttttagtagagacagggtttcaccatgttggtcaggctggtctcaaactcctgacctcaggtgatccgccctcctcagcctcccaaagtgttgggattacaggcatgagccactgcgcctggtcatattttctttatgggaaaatacccatgttggtggctccttgggtgggtttcagtatattactattacaacacagcatggcttcataatttgtgaagaatttttctagaccagggttcctgattcatagggtctgcatatcttcagttttactagatgatgccaagtaattgttaccatttttgccagtgtgatggctttaaaagagtttttcatcatggagtatatgtgtatgtggctttactttatttcccaattttcattttgagaaaatttcaaaactacagatcaggtgcaggactagtacaatgaatatacccttcacttagattcactaacatttgctgcatttgcataatctatcttttcacctatgcatggtgttcatacacacgagtatattttattttcctgaaccatttgagaattaattgtagatatcattgcattttccatctgtatctaattcagcatgtatttccaaagaacgtggacattcatttatatgatcacaataccgttattgtactcaggaaagttggcatttcattatttacacaaatgttatctaatatatagcccatgttcaaatttccctagttgccccaataatgtacttgccttaaacaacttttgattttttttttttttttcgagatggagtgttactctgtcgcccaggctggagtgcagtggcgtgatgttggctcactgcaacctctgccttctgggttcaagcaattttcctgcctcagcctcgcgagtagctgggactgcaggcgcacgccaccgcccccgcctaatttttgtatttttagtagagatggggtttcaccatattggacaagctggtctcaaactcctgacctcaggcagtccacctgcctcggcctcccaaagtgctgagattacaggtgtgagccaccatgcccgaacttttttttttttttttttttttttttaagtctctcttaatctacaggctccccttccatcttttggagttgacttccttacagtttatctgttaaaacagtctggcacatttcacctatagagtttccaacggtttgggttttgctgattacacatttatgctatagtttaacgtgttctctgtactccctgcacattggcagctggatgcacgggctacttgaaccagatcctgtttgatccttttggcaatgctctagatccacgtaggcacataagtctggtttttgctttgtttttattggttttagcagctgtagatgctcaatgcctagacccattgaatctttgggggatagaaatggtgatattggccgggcgcagtggctcacacctgtaatcccaacactttgggaggccgaggagggtagatcacttgagatcaggagttcgaaacctgcctggccaacatggtgaaaccccagctctactaaaaatacaaaaaaattagccacacatggtcaggagattgagaccatcctggctaagacggtgaaaccctgtctctactaaaaatacaaaaaaattagccaggcgtggtggcaggcgcctgtagtcccagctactcaggaggctgaggcaggagaatggcgtgaacccaggaggcggagcttgcagtgagctgagatcctaccactgcactccagcctgggcgacagagtgagactccatctcaaaaaaaaaaaaaaaaaaaaaatcagccgcgcatggtggcacgtgcctgtagtcccagctactcaggagactcagtcaggagaattgcttgaagctgcaaggcagaggttgcagtgagccaagatcatgccacctcactccagcctggttgacagaacaagactctgtctcaaaaaaaaaaaaaaagaaaagaaaatggtgatattttgcttctattgtttcattttctcaaattagctgaaatattttgataaagaaccccttctcttatctactagttacccagttatagtttatataggaaaaacaagataattacttgatttttttctcttatttatccagtttcaaaataatgaattcattccctttcctcagaagatcacctgttagtttttctttaaaaataatggccaggcacggtggctcacgcctgtaatcccagcactttggcaggccgaggcgggtggatcacctgaggtcaggagttcgagaccagcctggccaacagggtgaaaccccgtctctactaaaaataaaaaattagccaggtgtggtggcacgcgcctgtagtcccagctactcaggaggctgagactggagaatcacctgaacctgggcggtagaggttgcagtgagccatgatcgcgtcactgcactccagcctgggcgacagagtgagattttgtctcaaaaaaatagggccagacgcggtggctcatgcctgtaatctcagcactttggggggctgaagtgggcggatcacgaggtcaggagatcgagaccatcctagctaacatggtgaaaccccgtctctactaaaaatacaaaaaaattgggcgtggtggcacatgcctgtagttccagctactcgggaagctgaggcaggagaatcgcttgaacccaggaggcggaggttgcagtgagccaagatcccgccgttgtactccagcctgggcaacaagagtgaaactccatctcaaaaaaataatataaataaataaatatatatatatatttatatagagatggatatatatgtgtgtgtgtgtgtatatatatatatatataattataggctgggcacaatggctcacacctgtaatcccagcactttgggaggctgagacaggaggatcacttgagtctaggagtttgaggctgcagtgagcgctgtgttcgtaccactccactccagcctgggtgacagagcgagaccctgtttcttttcttttcttttcttttttttgagatggagtctcgcactgtcgcccaggctggagtgcagtggcatgatctcggctcactgctagctctgcctcccgggttcacaccattctcctgcctcagcctcccgagtagctgggactacaggcacgcgtcaccacgcccagctaattttttgtatttttaatagagtcggggtttcaccgtgttagccaggatgatctcgatctcctgacctcgtgatccgcccgcctcggcctcccaaagtgctgggattacaggtgtgagccgctgcgcctggccaagaccctgtttcttaaaataataaataaattaaaaatcattacgggtttatagatttaaacatatttgatagttttgaatgctttgtaattcttggtcttattaaagttcaaactgtcccattttgctagtggaagttggctctgagtcctcttgacatgacccaagtagtctgtgatagttacctcactatctagcatgtgaagatgttcccagaatttcccatcgtggttttcatttacattgccctgattgagcatcttttcacaggtttattggcttcttcttgaaatgcctgttcatgtcttttggccactttttatatgggtcatttgtcccttattgatttataagggttctttatttttttcctagatattaatagttttggccagatgtttgcagatgtcttttctcaatatggcttgtcttttcagttttggtgtcttgatgatcagaagaagttcttcatgtagttgatttattgaccttttccattatggttttcactctttgactctaggagcttaataaaagcatgaaatatttattgattgtccattgctaatccgaaaccctttcagaatagtcctaacccaaggtctcagtatcagagatgaaggccagttgtgggtgtcaggaggtcagttgtgggtgtcagtcctcagggtcacagatggctcttttagagttgtcttttttttttttttttttttgagatggagtcttgctctgtagcccaggctggagtgcagtggtgcagtggtgcgatcgcgttcactgcaacctccacctcctgggttcaagcaattctcctacctcaggctcctgagtagctgggattacaggcgtgcgccaccacgcctggctaatttttgtatttttagtagagacagggtttcaccatcttggccaggctggtcctgaactcctgacctcaagtgatccacccgcctcagcctcccaaagtgctgggactacaggcgtgagccactgcacccgactagagttgtcttttttttttttttttttttgagatggagtctcgctctgtcgcccaggctggagtgtaatggtgccatcttggttcattacaacctccgccttctgggttcaagcgattcttccgcctcagcctcccaagtagctgggattacagtcattcactactatgcctggctaatttttttttttgtatttttagtagagacggggtttcgccatgttggccaggctggtctcgaactcctggcctcaggtgatccccctgcctcggcctcccaaagtgctgggattacaggcgtgagccaccgcacccagcttagagttgtcttataattagctaaacacagcagtatgtctcagtaaatatcatattttagtttttcactagcttttttttaatgcaacaaattactatcacagaattgtacaatgactgctgaaggccaacactaattatttaaaaggcaggaaattaataaagaagcataaacctgttaccaatgtgaaaactgagcagaacttctaaagctgagctgttaatagttttattcaggcccttgctggctcagcaggaaaatgaaagggaagcagcagccaccaccctgagtaaacatgccctgctttttcttcctccattagaagttcctcggctctctaaacatggcaaagtttggctgaaagtaagtcatgtagttttaaaatgttcatctttgaagtaagctaatcacagaaggacaattactgcatgattctacttgtatgaggtatttaaaatagtcaaactcatagaggcagagaatagaatggcgattgccagggattgggggagggagagatagggagttggtaatcaacaaagttttagtcaagcaaagagaataagttctacagaccccttgcacaacactgtgcctatagataacagtaccgtattgtacacttaaaaatctgccaagagggcagatgtcatgttaagtattcttaccactgtattttttttaaatgacagcttgatgggttttccataaagttatgagtttgtgctttgtaattttttgctgtctaaaattctaagaactacaggtattaggaaatgattttgaaatgattttttctttctttttaaaaacaccattatttaccaaaatgaaaagttagaaatcctgaataatgtcatctcctctttagaaaggaatgcactcttggtatcagtgggcaggatacagcgttgtccagtggactaagaggagcgggagcaccagactcctaccccacctctgcctcttactagccctgaaaccttgggaagttactccagctctgtgggaactggcatagtacctcctggagctgttttgaggattaaataaggttatctcatgtgaggaacatatgaaatggctggactctagccacatgatagtcatcaaccaccactcatgtgatactgcacattttcgcttctgcctgagaagataatgtccactgatagaaaatggaaccataccctgtagtcaggaatccttatgtcattgttttagttttccattgctgccaaaataaatgactgcaaatttacaggttgaaagtagtgcaaatgattatcttagttctgtgggtcagaagtccaattctaaatcaaggtgtcagcagggttgcgttcctttctagaggccctaggggggaatttctttcctgctcatttagattgttgacagaactcagttcctcgaggctgtaggaccaaggtctgttttgctggctgagggctgtttccagcttccttcctctattgtcgaagcctgcagcaagtcgtttgcagatcccccttctgacctcttcttctgcctccctcttagactgcaggcactcttatgcttgaatcaagcccacccagataatccaagatcatctccctattttaagggcaactgattagtaaacttaattccaatgcaaccttaatttccctttgctgtgtgaggtaacagtcacaggttccagaaatagaagacatctttgaggggccattattctgcctacctcatcaagtgaactagaattgtgttggggtctttaacaggtcatttatccttaccttttattttcttcatccaaaaaataaagtggcctgccatataggatagataatgtttattgagcacttacttgctgtgagcttggcccttggcgctaaactctttgctcaggaagagtctttgaggtgggttctattattatccccatttataagtgaggaaactgcattttggagaagttaagtaattgttgaaaataattcaactggtgagggagtcagacatttcagtaggctgctgtacctcaaaggtttggctggctggcaatcagccttcacatggcaggcatactaattagaaatcagtgtcttgattttcttaaaaagttttggttttgctagcagaaattgtcatttgtgcccaggcacggtggctcatgcttgtaatcccagcactttgtaggccgaggcaggcaaatcacctgtggtcgggagcttgagaccagcctggccaacatggtgaaaccctgtcttcactaaaaatacaataattagctgggtgtagtagtgggcgcctgtaatcccagctactcaggaggctgaggcaggagaatcgtttgaacccaggaggcagaggttacgtgagctgagattgcgccactgcactccagcctgggtgacagagggaaactccgtctcaaaaaaaaaaaaaaaaaaaaaaagaaattgtcatttgtgttcatggacgtggtaagaaaataaaaactgaaatcagatatgtatgaaaatgagttacaaaatattctagataaaactttctctgtctgaaaatgcaaaaaaaaatgatttctggcttgtgctaaatcacgaactgttttttgaagtcagaatgttgttttgtctgagatcctggagttctctgccaagagagatctgatttgtgacagggtggtggatgggctcaatatttttttaatgagatattggactgtgctgttttgttatactataagtgatatgtaaccaaacaagaaaattttcctagcaacaaagttgttttcctgaatcagaagaatgcttttgtgtgctcattttcttattgtccaaaagataaaaaagcttgtgaatttagcatcttatttttttgagattgaggtactggcgagtatagatagtagaatatataagaatatcattggaagtatttggcaagcagtatgttaattcagacctaaactgtatttaagtagagaactaacttgtttttttgtttgtttgtttttgtttgtttttgagatggagtttcactcttgttgcccaggctggagtgcaatggcgtgatcttggctcactgcaacctccgcctcctgggttcaagcgattctcctgcttcagcctcccgagcagctgggattacaggcatgcgccaccatgccctgctaattttgtatttttagtagagacggggtttctccctgttgttcaggctggtctcgaactcctgacctcaggtgatccacccaccttggcctcccaaagtgctgggattacaggcgtgagccaccacgccctgccgagaaccaccttgtttttatgccagacccgattgttggacatgattatctcactggcccttataagcctttttttctctcttcttgttcttcattagtctggtgagggacccagacatttcagtaggctgctatacctcaaaggtttggctggcaatcagccttcacatggcagtcatactaattagaaatcaatgttttgatttttttttaagttttaattttgctaacagaaattgttattcgtgttcatggatgtgttaagaaaatagaaacccaagcttttttacattcatcagatctctaagttctaccccattccatttgtttgtttgttttgagacagggtctcactctgttgcccaaactgtagtgcagttgtgcagtcacagcttactgcagcctcaacctccctggcttaagtgatcctcccacctcagcctcctgagtaggtgggaccacaggcatgtgtcatcccacctggctaatttttgtattttttttagagacaggatttcagcatgttgcccaggctgatcttgaactcctgggctcaagtgatccacccgcctcggcctcctgaagtgctgggattacaggtgtgagccactgcccctggctttccatttgtttatgcaacaaatatttgaatagtgtgtgctaggaggccctagggatattgtgccctcatgaagcttacaggttaatgaaagactcaaacatgaaagaaataattacacaatcaggaagtacatgagtgctatgaaagggaatagaaggttctgctaaattgaaggacagggtacaaagaaagccttgatgtaaaggatgaataacatttagctaggcaaaaattgggattgtctggtctcggtcagtggggtatattttgcaaaggtcttgtcccagtagggagtttgtcaatttcgagcaacagcaaaaaggcctctgggttgtaggtgggtgtgtgttcacatatgggtatgtgtgttcgcttgtgtgcatgcatgtgaggaggcagggtggggagtggctctggaggaggagaagggcacagattctcagtcctgtagcactcttgttcagagcatcaagtagacctgagaattgtatgttgatcattggtccgccaagcagttcgtatggccttgtttcccagaactccatcatcaagtggatgtggtgaccatatactttatcatcaaaaccaggatactctttttttttttttttttttttttaaacttctttttctatgttgcccaagctggtcttgaattcccaggctcaatggatcctcccgcctcggcctcccaaagtgctgggattacaggcgtgaaccaacatgcccggcaaaccaggatactcttgagagtgaaaggggacactattaattatgttgggacaacgggtataaaacagtacttatagaccagttctcagccactccagggagccccaaagttgcctagaaaccatgctctgaaatgacagggttagtcacgtgctcctgctttctcaccttttcctcttccttcatccatgaataactctgaaagaggggcaccaggagaaactgctccaagtctatacaacagaatcttagcccccatggcccgcccagctgcagcctcctgtttttcagactgccatctgatctctgactattaatgtgttttcagaattaaagtctaaaaaacgtatagaaaagaaagtaaggccttaaaagtttagcacgtgaacttttcccactagaagcttttcctacactgcttcttatggattacatggcctaattatatgttcccggagggccactgggcagaatgggtgtggtctaacttctttcagagtaaacatgttttgtggattggcccctatggtggataatggtgaataatgcatggagtaaatacctacaggaagccttcccataggtgtaaaacctttatttcaggaaataaaaggaagatatattgattttttaattagaatcaactgtttggctgaatctgcataatgaggattaatggagctttatttcctgctctctctgcccaagtcactctacagtagggccctcagagagccctagtaacttcttcaatttactgacagatggatcactttgcagtaaaataatatttaatggtcggtaactgcgagaatgtgggatctcattgtcctcctcagcctttcttcaacaaccccccaagtcctcaataaaatggtttgaccctgtcccccataataatttttaatgttcatgttcagccaaatactcaggacactaaggagttgcactatttcttttcaaactgcattcaagctctttcttttgttttaaaagccaggaaatgtgaagaattcacctggaactaagtagaaaactccatgctctgccatcttaatcaggtaaaaaacaagaaatttctgtgattattttcagcattgtagtgccagctgaaatgacttgtttttaattaatttaatttaattaattataacagtttcaatttgatgtgaaaatattttattccatcttttagtttctgggcttaaatgctgtgacttacttatttgtgtttgttccactaatgttacctgggttttttagacaagctagaaccagacagttgggatttgtctacaaatgtatttcaaacaattgaaaagtgtcattattccttaggtttttttcaaacaacactttattatagtaagtacacttgtatttatctaatactcagtgaacactggaatgcatgactgttacagagaggctcaaaacactagttatattgtttgtgtatatatgaaaaattgtataatagcacttgtgatttcctggtaattagaagactgtaattgaatttggaagcaacctagatattcaactacaggaaaatggcttaattatggtatatctataaagaagaatattattattctgtttctacagtatttaattgcatgggaacgtgtgcacaattattgttaaatgaaaaaaaggtagtgtgatatgtttatagaggggatgaagccaggagatacgacagaaagtgtgtatctttcagtggcatgatgatttttatatttttttcttctttataactttctgtatttaaaaaattttctgcaatgagtatgcattttataatcagaaaattttttgaaaattggtgttacatttattgtaaatcatggcccttacttaaaatttatgaaaaccctgagtttgaagggtcttttttcctcaagctttctttatatttttggagacccaaagagtcacataaactgagaatttgagagtggttatctggcccaacccccagcctcaagcagactcccctgaaaccctgtatgttccttcttttacaccagcactgatgggaaactcaccctatggggcagccatcctgggacaattctgagtttttggaagctgtttcctctgctaagcaaaaatatgtctccttagtggtcacagaaaacaaatccagttcctctttcacagcatagctgttcatacagtaacccaacatcagtatgttctcagatacaaactattacccggggagcttggtaaaaggcaaagggcaccccagaatcagtatctctggtgaatggggccagatatgcatgggatgtgccattagaaggatgactggagggtgagcagccacagagtgacacatgtcctctagagacttgacttttaatatggttatatttctctctttttttaaatccctgtcagccagaatggatatatttctgtacagggacaatgaaaaagacatagaataaagggaaattaggtaaatatccatttcaattttcaaagatactctgcaccagagttcagcttgctgaaatacacaaccttgacttcattctttattgtttttagatctttattggaggaggtgtagcttttaattataaaagtgattcgtgttggttgtaaaaaatgtttttagctaactgttttaaaagcttgtcttggccgggtgtggtggctcacgcctgtaatcccagcactttgggaggccaaggtgggcagatcacgaggtcgagagatcgagaccaccctggccaacatggtgaaagcccgtctctactaaaaatacaaaaaaaaaaagccaggcatggtggtagttgcctgtaatcccagctacttgggaggctgaggcaggagaatcgcttgaacccaggaggcggaggttgcagtgagccgagatcgtgccattgcactctagcctgggcaaaaagagtgaaactctgtctcaaaaacaaaacaaaaaagcttgtcttatcctttattcttttctttttctttctttcttttttttttttttttttttgagatagagtttcactcttgttgcccaggctggagtgcagtggagcaatcttgctcactgcagcctctgaggcctcccgggttcaagtcattctcctgcctcagcctcccaagtagctgggattacaggcatgcaccaccatgcccagctaattttgtattttttagtagagacagggttttagcatattggtcaggctggtctcgaactcctgacctcaggtgatccacctgcctcagcctcccaaagtactgggattacaggtgtgagccaccacatctggcccctttattcttttttccagaggtaatttttgttaatagtttggtatatcattccagacttttaaatatagatagatagatagatagatagatagatagatagatagatagataggccgggtgcagtggctcacacctgtactcctagcactttgggaggctgaggtaggtggattatatgagtctggcagttcgagaacagcctgggcaatatggcgaaaccctgtctctacaaaaaattaaaaaaattagctgagtgtgatgacgaacacctgtagtcccagttacttggaggctgaggtgggaggatctcctgagcctgggagaaagaggttgcagtgagccatgatcactccactgcactccaacctgggcaacagagtgataccctgtctcaaaaacaaatatatatatttatttatatttaaaatttatttataaattaaataaatttatttatacatttataatatattcatgcatacatgcatgtttttggttttttgacaaaatgggatcatattccacatattgttttacaagttcacagaaaactttctttttactgttatttatctggggggatgggatcttgctgtgttacccaggctggacttcaactcctgggtttaggtgatcctcccacttcacccttctgagtagctgcacagaaaacttactgaaggcatataattgtaattatattatcatacataaagaaattaggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaattttttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggggaaaaaaaaaaaaaaaagaaattaggctggggctgggcgtggtggctcacgcctgtggtcccagcactttgggaagctgaggtgggcggatcatgaggttaggagtttgagactagcctggccaatatggtgaaaccctgtctctactaaaaatacaaaaattagccagacatggtggcgtgcgcctgtagtcccagctactcgggaggccgaggcaggggaatcgcttgaacccgaaaggcggaggttgcagtgagccgagatcacgccactgcactccagcctgggtgacagagtgagactctgtctcaaaaaaaaaagaaaaaagaaaaaaaggaaattaaggccgggcatggtggctcatgcctgtagttcaaactactcaggaggctgaggcaggagaattgcttgaacccgggaggtagaggttgcagtgagccaagatcgtgccactgcacactcccagcctgggcaacagagagagactccgtctcaaagaaagaaagaaattgcactaattccttaacatcatctaatatccagttcaatgtacacattttcctggttgtttcatgaataactttttacagttggttcgtttgaaccaggatccaaacaagatctgcctgttgtgtttgactgataggtctcttagaactgtaatagtttccgctccctcattgtcccttgctatttatctgttgaaaaacctggcttatttgtcctttagaattcctgttttctacaaggattgagctgggaggggaaaaaaagaatttctcatgttctggctgtggccgaatgtatccatttagtatcattctgtttatctcttggtttctttcttctctatatttcccataaacttatagttggatccgaaggcttaattagacttaggttcattttttttttttgccatagacagtactatattaatctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgcaataaatctatcaaattcctggggaagacaaaagcagattaataaactgagatagaaaaaataagctagtagtttacatgtttaagaatttttggttgtatattaaaagatcaagtgaatagtcactggcctctaaaatatttagaaatctccaattgtgccgggcacggtggctcatacctgtaatcccagcactttgggaggctgaggcgggtgaatcacctcaggtcaggagttcgagaccagcctgcccaacatggtgaaaccacatctctactaaaaatacaaaaaattagccgggcgtggtggcgcctgcctgtaatcccagctactcaggaggctgaggcaggagaattgcttgaacccgggagatggaggttgcggtgaaccgagaggacgccactgtactccagcctgggcaacaagagtgaaactccgtctcaaaaaaaaaaaaaaatctctaattgctgagtatattcattacaaattatgaaaaaaagccaggcgtggtggctcacggctgtaatcccagcactttgggaagctgaggcaagcagatcactttaggtcaggagttcgagaccagcctggccaacatggtgaaaccctgtctctaccaaaaatataaaaaattagctgggtgtggtggcgggcacctgtaatcccagctacttgggaggctgaggcagaattgcttgaacctgggaggcagaggttacagtgagccgagatcacgccactgcactccagcttgggtgacagagcaagactccatctcaaaaaaaaaaaaaatatgaaaaaagcaatctggagaagactcagtttgtctttgacatgtctttgactatatgtgtattttattccagaaaagtatgatgggggtgatgcgaggaaaattacacatcaaactgagggtgatgtaatcatgctttccagcagatagatggaaatgtagttgtttaatcttcagatgtgatgtgtactgtgccatttaggcatttgttttttatttattcatccatctagttggttaattacactcagatacacagccaattgaggatctgaatgtagtgtatatgtaatgttgatggaacacaaaatcttttttttttttttttttttgagacagagttttgctctgttgcccaggctggagtgcagtggctcagtcttggttcactgcgtcctctgcctcccgggttcaagcaattctactgcctcagcctcccgattagctgggattacaggcgcccgccaccatgcccggctaattttttgtatttttagtaaagatgggatttcaccatgttagccaggctggtctcgaactcctgaccacagatgatccacctgcctcggcctcctaaagtgctgggattacaggcatgagccaccacactcgacctttctgattcttagtttaactgtctttaaaatgggaataattacagttttctctggctcatgtttcttatggtcatataatggtgatgtaaatattttctatggtttctctatttatttatttattttgagatggagtttcattcttgtcgcccaggctggagtgcaatggcatgatctcagctcactgcagcctctgtctcctaggttcaagtgattctcctgcctcagcctcctgcgtagctgggattacaggcacttgccaccatgcccagccaatctttttgtatttttagtagagacggggtttcaccatgttgggcaggctggtctcgaacttctgacctcaggtgatccacccgcctcggcttcccaaagtgctgggattacaggcatgggccaccgcgcctggcctggtttctctatttaaatctgaagaattttcataatgcaaaattttttctggcacagttacttatgtttttcttttctttcttttagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaa

SEQ ID NO: 4431 - DNA, 74576 bp, human
gggtttgcgttcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtgagagcgtggagtcgagtcacagctgtcaccgccccctcccggccgcccgagccctccccgcgctctcttggggcctctctgcagccaggcctggctcaccccgaggcttttcccgccactgggccggctgcgtcccggccccgcggttcattcactggtctactggggatgagcggctgccgggcggaggcgggagacccccgggtgggtgggggcggccctttgggttgtgctttcgtgaattaaacactttgaaaatttaaagtgccttcccccaaagtacccatcccctcggctagtaccctcttgggatcgtgggtagggtgaggccagctcagggcactgtggggttcgcggctttagttgcctggcagggtcaggtttcagaacctgatgtgtggatgggggagggtcattttaggagaagctgtgcagggtatgggggaggctggggtgggatggctgggtgacgagggaagctggagctttgctccactcctcagggaacattatttaatacgggccagtggacccccttccctgcgttttgtgaactcgtgtcctttggaaaaaaatcgacttttacgatgaagacttaatttcgaaaatctgcactttagcataaagccattattctactttttaaaaagtaaattatatgtattttgtcataaaaaatcacaggctaccagaaattaatctacaaaattgagtcttcaagaagcatagtacccataaaatagtgctaatgaaatctcagaattgtactattcatttaaaagttttattgagctctgcaatgtgctttgggtacgttaataaaggctgtaaaatcagaacatgcattctgccttctagtcctggcattgccactttctagctgtgtgaccttgggcaagtcactgtgcctatcttcctttggtgaagttggggtaataacatctacctcatagggttgttataaggagtaagttggtatgtgtaaagcacttggaaaaggcctagtatttgctcttactctgttttcaggcagctcacagtttagtcaggaagacagatcctataatcaacattcatttgataaatttgtgtgttaaacacctgttatgtgctaggagctcagctccatttcagggttacaacaaggaaagatatgctgtggccagtttaactatatgtgtaccaacagtgtagtaaagtagtaaaaaggagagcaggatccacttggcttaaccaggggttcctaacctggggccctcagctcctcaaaggatctgcacatagatttcagaggatccctgaactttgatggggaaaaaacataactatttttagcaatctccaattggaattgagcacttcctttagttacgcatatgggtaatgtctcagttatctattgttgggtaacaaatcactgcaaaccagtgccttaaaacaagaattgtttctcaaaatctgggttggctgggcagttctgctggtgacttgactgaaagttggcttcactcccatgtctgggggcttggtgcccctccatgtgcctaggttggacttcctcacttggttactgacttccaagagggcaagtcccaaggcacaaacacagcatcatgtttgctgatgtcaaaacaagtcacgtagccaagtccagagttgatatggtggggaaccacacaaggtcatagatatgagttggtgcacttcgctgggggccattcattttacaagttcctactgtaacaaatcacagtagtattagcagtacctgttaccagtagaagtcacagtaccagcacaagtcacagacattttcatattacattacagttgttgcagatgtcaaaatatcacttatgctcattactacttcagaactatggtagttataagactcactgctagatctttttgtttagtgggctagtaaagaagcacatactgcttatatcagatatttgagtttaaaaaataagattatttcaatatagttgggacttttttgtatgcaattagaagcattattttgagaaggagtctataggactcactgacggccaaagaggtccacggcagaaaaaaaggtaaggaacccctggggacttcagagaaggcttcacagacgggacacttaaatttagttttgagacaggtaggagttcttcaggtaaaaggggtggggaacatcagtggtattccattgggggaagtgctggaagctcagttttgatgtgtcaagggaaagacatagtgagctgagattattattattattattattgttatcattattatttttttcagacagagtctggccctgttgtccgggctggagtgcagtggtgcgatcttggctcactgcagcctccgcctcctgggttcaagtgattctcctgcctcagcctctgagtagctaggattacaggcgcccgccaccacgcctggctaatttttttgtatttttaataaagacggagtttcaccatgtgttggccaggctggtctcgaactcctgacctcgtgattcgcccgccttggcctcccaaagtgctgggattacaggtgtgacccaccgcgcccgactgaactgagattatttcaggtgaacatgtactttgggtagaaaagatcacaacaaaccttggaggacaccaaaatgtaggagtaggcagaggaaagggggaggccagacttgagaagcagaagtaggagcagaaaagagtgatgtttagaaaatcgagggagaaaagtttcaaggagaaatggctatgttaggatgctttcagctgggaaaacccaactgcttaaatagtaaggaaaattctctcacaaagtccagaggaagaatggattccaggctctgattcagttggtcaacagtgtcaggccaggcacggtggctcacgcctgtaatcccagcacttcgggaggccgaggcgggcggatcacgaggtcaggagatcgagaccatcctggctaacatggtgaaaccctgtctctactaaaaatacaaaaaattagccgggtgtgttggcgggtgcctgtagtctcagctactcgggaggctgaggcaggagaatggcaagaacccgggaggcggaggttgcagtgagctgagatcgcaccactgaactccagcctgggagacagcgagactccgtcccaaaaaaaaaaaaaaaaaaaaaaccagtgtcatcaaggacccatctcttcttgggtttccacagtcaggttggtttcctttagggttgcaagatgactactagtaacatacacactttctcattctctagagcaagaggaggaggagagagaaaaaactcccacacttggtccttcagtctgattggaccaacttaggtcagttgtctgaccctgtaacagttgtcagaggaatgccatgatctgattggcttagactaaacaggatcaacccagggtggcgtcacttaatcacaggggagaggaatgcattcatgaacacaatggagttcttttaggaaggaagagggagaatagagactggatatgcaaccaacaatgtccatgacggagatataagctagatgagatatgagttagttacatatcatgagtcgtgttcactgatttgggcactttggaaagctttcatgatccttatactttaggtttactgatggaagtgaagggtagattaacctgggttggtgactgagggccaagtaagtggacactatgatggttgataagcttgactatcaagggaaggagagagaatttggtaactagaaggatatgttcagtcaagattctagagagaatacctcagctgtgcaagggagagatattcccacccgagagatggaaggaaaagaaaggtgcgagagattgtagaccagtggttctccatagaatggtacgactcaacagaatggtatgttttggaaacttgtggggttgttctttttttcttttttcgtttttaactttgcaaaaattataactgaaaatggggttgttctttatgtctttagttgtgttgaacatttacatactgaaatataattcacataaatctttcctttttattcacctttatgctaccatcagagtatactgatttactttttggacttatgcatgtaacttagtgatgaattttatttcaggataccagaagagtgtcagaaaatatttgtcataaaatggtgatgttaggtctagtagttgagaaccagtgcttgtcaaactttaatgggcatgtgactcttgttaaaatggattccaattcagtaggtctgggatgcggcctcaaatgctccatttttttttttttttctagatggagtctcgctctatcacgcaggcttgagtacagtggcgcagtttctgctcactgcaacctccgcctcccgggctcaagcaattcctctgcctcagcctcctgagtagctgggattgacaggtgcgcgccaccatgcccagctaattttttgtatctttagtagagacggggcttcaccatgctggccaggctggtctcaaactcctgaccttgtgatccacccgcctcagcctcccaaagtgctgggattacagacgtgagccgccgcacccggccagattctccattttttaactagttctatagttttcgttggtcccctttgactagcaagaattgaagccaatcggtagatgaatggttcttgtgttttcgagatggatggtcttatgaacatggtgggatttgggagaggcactgaccaaggaacaaaaagataggccagaccctttgagggctctgctgagagcactcctgtatgtttgtgcagagtggggatggagtaaacggtaggattgatcggggtttgggagttaacagcttgggttaactagaactggagggcaaaggagttaatagtataggtgttggtagtaaaagtacaatggtagtaaaagtgcagtgtgtctgactagttatgtgcatattaagtacacattgtacttaaaatatatactgcgatgttttgatatagttattcatcttcaggtcactagggggcattggtggattaaaaaacacatttgaaaagctgcccagtatttgcattccattgtaggaagcagcttttccttgtgctgctgcaggaagtttgaatattggatacatatacccagattcacgttattagatttccttcattacacagattttatcctagtccaactatgggctgggcatcatgctggaccctggtgggtacaagtgaaaagacccagttcttatctaggagagaggtcccaaatctggccacaaatcagaattattcaaggagacagtttccaagcccctgcgcatggttctgactgactttttagttggcgtccaggaactgctagttttgaaaaagccccccaaggtgattatgaaactttcatttcagaagctcacaatgcacttaccagcacagacattaaaggtccgttaacgatgcagtgggtctcaaccttgactgcatgttagagccacctggggagcttttaaaagtcccgatgcccagtctagaacctataccaatgacatcaagaatctctaggggtaggattaggcatctagtttttggagcaagcagccagccttgagatctactgacttagagggaagagcaacagcagggggcatcagaaggctttatagagaagaacatgcctatgctgatctttggagctaggcagacaaggttgaaagggccttccaaacagagaagaaaagcacatgcaaggacacagaagtgtgagagtgttcagaacagtgttaagaccttgggcttcactgtgttccttgtgagagatactaaagttttctgtagctgcttcctcatttgtaaaacaaggatgagatgcttaccaacctcaaattattgtgtggattaaattcattcctacgcaaagcttagaacagtgcttggcccaaagtaagggctgaagaaatgtgagctgttacttttagttggcatcttgtaagatggcatcttgtaactacctgtgttacggtggtgcacggtcttggggctctccaaaagtattttttatttcaaaacttggtagtcagttggatgtggtagatgagggagaaggataaattaaggtttctgcccaggcttttgacttttgactgtgggatctattcattgaggtgggaactattcattgaggtgggaaagtggaagaaggttgaatttggtttgagggggaggtgatggtttggttttgaacaggttgggcttgctgaaatatctgggcattggaagggggaaatcagttgatgtagaaccccagggtatggacttttcctgccacagacgtgggctggaaattgggaaatcatcagctgctaactgaagcctccagggcaagaaggtggcctagtgaaaactggtctgtgtcacttccttcctcaagggcaaataacatgacctgtactcagagctcaccacaccaaggagcctgagtgaacatgtccatgactatgaggtgttattacctcacacattctttgtggcttagtgtaatacttacattgcctgtcttcctgaaattaattttcttaccatgttactagtatgttactagaactgcgcggagaattacaatgctaaatggaaaaggaaaatcatctgtaaattggaagagtaatgtaacttttatacttgagcattattttaaaagccacatatttggaaagataatgaaggttttttttccctaacagtttaagcatcttcaagggaattcttcttgaggaattatagtaactacatttttactcacataaatacattttttatgtgcagaatcaattggttgtttctttttcctttcttacctttcgaagaagttagacagtggatcacagagacgaagaaaaaactgctctgtagctctggatgcaatcttttcagcctcaggttctagttgtgtttctggctgagcgaccttgttgagatttctttttttttttttttttttttgagccggagtcttgccctgtcacccaggctggagtgcactggcgcagtcttggctctccgcaccctccgcctcctgggttcaagccggtctcctcccttagcctcccaagtagctgggactacaggcatgcaccagcacgcctggcctagtttttgtatttttattagagatggggtttcaccatgttggccagactggtcttgagctcctgaccttaagtgatctgccctccttggcctcccaaagtgctgggattacaggcatgagtcaccatgccgggccagttgagatttcttaatctctcagcgtcctctgatcatgatcctgtggggatagtagtatgtccctctgtatctcacaggattgttgggagattcaattgagataatatgcgaaaagaaccgtgaactacaaagcactatatcaatgtaaggtgttttctgttcctcttgtatcacatttgtccactgaagtaatctatgcttgcaggttagcactctggacttaacaactgtaaaacgtgaattaacttgggttatttcacttctcatttggaaatgaattctgctcaggacactgtagcattcttctatctacttctgaaatgcagatagcctcacagttgtaactaacactggaagaggagaaagaagaagtaaaacgatacattaaaagaacggagagattagaggcacagtggaggagaaaagtagatgatgtaccagacatttatgataaatgaattgattaccccatgaggcctgttgatatttgtagacttttatgacgtaaaggtttaatttataatctatatgtatatgtgttccacacccatgtcctttctaggctagactggaacttcttagaggctaggaaacgaacttgcatatttgtttgtattgtacatttaaaattagatatataaatgcatgttattaggtgtgtaataaatctcaatagcaaagatatctgtttcaaaaagtttagacttatttttaatatgacaagaaagtactaagagatctttaaaataaaggaattgaaagagtgtatcagttgattttccccaataatgcttaagtggaattttacagttagttcatacagcatgaaactttatatattttcagggacaaaaaaatcctagtctaaagttatattttagaatttggaagttatttatttttcacttttgctgagtttttcctaatttttgcatagcctcatgccagttttgttagaaaatttaatcagtgccaatttcttaatgtggtaggtttttaaacttattttcagtgttcactaaaacttggagaagcaggaatgtagggcaagggtcgtagagttttcagtatgctgaaagcctatgactttgattgttaagctatattttcctgatacagctttatgcattatggatagtatagttgaattttaagtgaatattgttttaaaggcactttaagtgcagttatcctttgtcttcctatttctggctgtttgaagcaatgcagcgtgttttattcaaagcccacactggctcccgcttaaggacttctttgtttggttccatgaggatgaggagccccctctgtgggagctagagatagatccacaagtgcatgttcattgccttagtgtggaggaattcccagtagtttcttttttcagatattcctgaaaagaagtctattccttcttctgaacagtcttttaaaatggaatatatgaaactaactaataaaggttctttttttcttttcccccattccacaaacttcagtccttgtgaactagcctgtttttgtttgtgcttgctgaaaatgagtctcctctcctattagagatgctgattcatgtgacatgggttagactggtgagtgagtaagtaagcaaaaagtgattatacgggctccaagaagtttcctacattgtctgttgatggtttacctcacttggcagatagaactgagcctgtttgtggagtcacaccatttgggagtcctgttaaagttgctgggtatagtccaaacatttactttacttgtttttgttccttatttttgcacagattttcattatgaggtcagatggttatcaaccgaattgagtcttgtacatgattttttttttccaaaaaaggcttacagttttccttaaagaagaaaaacgcacatgaataactgagatgaagtcaaaggcagttttcattagtgagtttagagttctctgtgcacatggtggtctgttaagatatgaaacccgggtctaggcccgacgtggtggctcacacctgtaatcccagcactttgggaggctgaggcaggagaattccttgagtccaggagtttgagaccaacctgggcaacatggcgaaaccccgcccgtctctacaaaaaatgcaaaaattagccaggtatggtggtgcctgcctgtagtcccagctacttgagaggctgagatgggaggatcacttgagcccaggaggttgaggctgcattgagctgtgattgtgccactgcattccagcctgagtgacagaatgagaccctatgtcaaaaaaaacaacaacaaaaaaagagatatgaaacccatgtctaggtagattttttttttttgagacagagccatgtgtctagatagaaacctgtgtctagatagatttttttttttttttttgagacagaatcatgctctgtctcccaggctggagtgcagtggcacaatcttagctcactgcaacctccacctcccaggctcaagcgatcctcctgcctcaccctcctgggtagctgggactatgggcacgtgccaccattcccagataattttttgtattttttgtagagagggggtttcacctttagcctgttgcccaggctggtcttgaactcctgggctcaaaggatccgcccacctcggcctcccaaagtgctgggattacaggcatgagccagcatgccctgcccagatagattttactttgacagactagctctcctattaaatgatgtacattttattagttgcttggaaacacagatgcatttgaaaagctaaacttgaagtaaatgtttcccaacgattttttcctccctatatttccttaattcagaaaagattgagtgggtcccaggatgccattctaatagagaaaaaaacacatatatataggagtcttaagtagcagtaaatttctgtctggatgaggaagttcaaaataaattctggacttgataaattacatattatctgtgttccaagtctttaaaaccagtatagcccaactggatgactcaaaacctgcctaaatgaacaattatctcactctttggccctaaggttttcttcctgtttatcgcacaagtttattatttttctacatgaattttataaaatctaatcgctatctttaaagagtagaaaatgaaacaattgcagatgagacattttgtttgctttgctgacctaattttgtggtgaattctaccctccaaagatgaaacagaacttggttttctgtgagaaaaagataatattagtcttgaaaacagcctcatttttttctctgcttatctctttagattgtagtctgtttacagtggatgagaaagagctaggaaataccaattactgtagtacagaactaaagaattaaaaatttctcataaaatagttctatgtttgttgtattaggaagagtttttttaatgttgtttgaagtctaaactttactgggcatggtggttcacacctgtaatcccagcgctttgggaggccaaggcaggaggattgcttgagaccaggagtttgagaccagcctgggaaacatagtgagactccatctctaccaaaaaaaaaaaaaaaaatagctgagtgtgctccgtcacacccatagtcctaggtacttgggaggctgaagcagaaggattaggtgagcccaggagttcaaggccacagtgagctatgattgtaccactgcactccagcctgagtgacaaagggagataaattcttggctttatatcctcctttgctgtgaaacagatcgaaatgattgtgggttttattgttattgttaaagtatgagtgctcccaaattttacattcaaatgaatgcatcaaaacagtcgttttgagaggatagatttaattatactgtcattatatttattccaaaaattctatcactgatcaaaacatttttactcttcctcatttggaattatcttcaaactttgtggcaaacctttataatatcctcaggagctagccatttttgttctttgcatgttacaaaacaaatcaatggtttttttgtaaaaacttcaggaaatagagataagaattacctttaatatcaccacctatagacaaccactgttaacatcatattttttttttttgagacggagtcttactctgttgcccaggctggagtgcagtggcgccatcttcgttcaccgcaacctccatctcccgggttcaagcaattctcctgcctcagcctcctgagtagctgggattacaggcgtgcaccaccacgtccggctaatttttgtgtttttagtagagacagggtttcaccgtgttggtcatgctggtctcgaaccactgacctcgtggtctgcccacctcagcctcccaaagtgctgggattacaggcatgagccactgcgcccggccctaacatctttttagactccgttctggacatattcaaatatacccttggtatgacattttcaaaaaactcggtggaatcatactacaagtccccttcctcttttttttttttaaaaaaaatgccattttcttttcttcttcttcttttttttttagtagaatgagataatcttattattgaccaagtttacataaagcttgattctttaccgccaccaccaccacaacagaaagaaaagtttatgttggacactacgtttaattaggagatgtagaaaaggttccagtagagattgttttaatgaagactaatattgtaatttttttttctattttactctaagtcctgggatacatgtgcggaacatgaaggtttgttacataggtacacatgccatgttggtttgctgcacctatcaacctgtcatctaggttttaagccccgcatgcattaggtgtttgtcctaatggtctccctccccttgccctccatcccctgataggccccagtgtgtgatgttcccttccatgtgttatcattgttcaatcccacttatgagtgagaacatgtgatgtttggttttctattcctgtgttagtttgctgagaatgatggtttctagcttcatccatgtccctataaagaactcattctattttatggctgcatagcattccatggtgtatatgtgccacattttctttatccagtctatcactgatgggcatttgggttgcttccaagtctttgctattgtaaatagtgctgcaataaacataggcgtacagatgccattttctcatctttgtgtgtgtgtgtgtggagataatgaatctttttttttttttgaggcggagtctcactctgtcacccaggctggaatgcagtggtgcgatctcggcccactgcagccttttgcctcctgggttcgagcgattctcctgcctcagcctcctgagtagctggggctacaggtgcccaccagctaattattgtatttttagtagagacagggtttcacactatgttggccaggcttgtctcgaacccctgacctcaagtgatctgcccgcctcggcctcccaaagtgctgggattacaggctcgagccaccgaatccggcccattctctattctttaccactcttatttaaaatatatcgagactgattttctttactttttttttttaagcggagtttcactcttgttgcctaagctggagtgcagtggcatgatctcggctcactgcaacctccgcctccagggttcaagcaattctcttgcctcagcttcctgagtagctgggattacaggcgcactccaccatgcctggctaattttttctatttttagtagaaacagagtttcaccatgttagccaggctgctcttgaactcctgacctcaggtgatctaaccaacttggctttccaaagtgctggattacaggcgtgagccacggcgcctggccgagactgattttcttttaggcttaaaatgtgatctgaaggcatttagaaatggaagccatatgattacatattaaaagtaaattttggttgggtgtggtggctcatgtctgtaatcccagcactttgggaggcctgaggtcaggagtttgagaccagcctggccaacgtggcaaaaccccgtctctactaaaaatacaaaaattagccaggcgtggtggtgtgggcctgtaatcccagctacttgggaggctgaggtaggagaatcgcttaaacccgggaggcggaggttccagtgagccgagatcacaccactgcactccagcctgggtgacagggcgagactctgtctcaaaaaataataataataaaataaattttaaaaaataaatttcacttatgaaatttatataaatagttgtagtaaattccgactccatatatgatttatcaaggtaactgctttgaaaagaaaacatctatttaaaaaaaatgttgtaagtaatactgaaatacttttccttgtaaaaagtcaaaatagtacagttggtcaggttgctattgtccacctccccccagccccctttccagagaaagcctctgttctgtttggtgtgtggccctacatgttagaaaggattgctggccgggcatggtggctcatgcctataatcccagcactttggaaggccgaggcaggcagatcacctgagatcaggagttcgagaccagcctggccaacatggagaaaccccatctctactgaaaatacaaaaaaaattagctgggcgtggtggcaggcacctattattccagctactcaggaggctgaggctggagaatcacttgaacccaggagacggagattgcagtgagccgagattgtggcactgcactccagcctgggtggcaagagtgaaactctgtctcaaaaaataaaaaatataaaaataaaagattgctgtataaaatgtagatactgtcctgaatgctccttatggaggagagtattctgtattcttttgacgtttcaagaattgtggactcatttctcttgatttttatttttatttatttatttatttatttttcagacggagccttgccctgtcgcccagactggagtgcagtggcgtgatgtcggctcactgcaagctccgcctcccaggttttctcctgcctcagcctcctgagtatctgggactacaggttcccaccaccacgcctggctaatgttttgttttttttttttttgtatttttagtagagatggggtttcaccatgttagccaagatggtctcgatctcctgacctcgtgatctgcccgcttcggcctcccaaagtgctgggattacaggcgtgagccaccgcgcccggcctttctcttgatttttcattcaatttacaacacgttactgaggacaacagtgtagcctgattttgacaaaatttttttattgtcttcatcattttgttgtattctgagttctttcacatagttcttttttttgtgttggttacttagaataagaataatctcaaaagtattgtcagtgttcatagtttgttttttttttttgtaaaaaacccatttcagatttttacctcctaaataattagaatcagattaaaatagttttgtttcgagtgaaaaatgctgtcagaatggaaattattgcagaaaaggttgactgaggccaggcgcggtggctcacgcttgtaatcccagcactttttttttttttttgtgacggagtcccgctctgtcgcccaggttggagtgcagtggcgcgatcttggctcactgcaagctccacctcccaggttcacgccattctcctgcctctgcctcctgagtagctgggactacaggcgcccgccaccatgccctgctaattttttgtatttttagtagagatggggtttcactgtgtttctaggatggtctcgatttcctgacctcgtgaactgcccaccttggccaattccagcagtatgagaggccaaggcaggtggatcacctgaggtaaggagtttgagaccaccagcctagccaacatggtgaaaccctgtctctactaaaattccaaaaagtagctgggcatggtagcgggcgcctgtaatgccagctacttgggaggctgaggcaggagaatcgcttgaatccgagagacggcggaggttgcagtgagtggagatcgcgccactgcactccaggctgggcgacagtgcgagactccgtctcaaaaaaaaaaaaaataattagctgggtgtggtggtggctgcctgtaatcccagctacttgagaggctgaggcaggagaatcgtttgaaccccaggggcacggaggttgtcttgagccgagattgcgccacttcactccagcctgggtgaaagagcaaaactctgtctcaaaaaaaaaaaaatttattttcattctttatcattaaagagttgcttttatgttgtcctttgtgtggcttgtaggatcattaaataaggtagagaatctcataaaaacagttttggagaaagatagttgaaagcataatgtcatacattttaaatatataaatgtaaactatatatagaaatacataaagtattatatatacttaaactatataaactatatttttaagtatatatagtatgtataagtctataagtatatatatacatatagtttatatacatatatataaacttggtagaagggtaagatactgtaagtgtatatatacttacatagagagagtttaaattatttacatggaaaatagaaataatatattccatcactccaaaaaaaaggtcacctttggatatagcctgtttgaagtagcagttgaaaagcctggtaacatgtccctcagggagttagaaacacaggaaacacacaagcctgaggcttagggagaggcccaggctagggatactgatttgagcatcagtagcatatgagtgggagttaaagacttagattttggccaggtgtggtggctcacgcctataatcccagcactttgggaggctgaggcaggtggatcccttgagcccaggagtttgagaccagcctggccaacatggcgaaaccctgtctctactaaaaacacaaaaattagctgagcgtggtggcgggcgcctgtaatcccagctacttgggaggctaaagcatgagaatcccttgaacccgggaggcggagattgtagtgagccgagatcaggccactggactccagtctgggtgacagagcgagactctgtctgaaagaaaaaaaaaagaaagaattagattttaatgaaattgccctggagtgagaagaggagagagttaaagactactccatgactcatcaaccttgaagagctatgcagaggaagagaaggcccaaaaggggaggagagagtacctagaaagcctctagaatggggatagggtagaatcctgtaagccaaagaaaggggttgaagatgtagagtagtcaccagtttcagggtgcaaccaagatgccagatgtccagtggggtttagcaactgggaggctattggtggtcttgggaagaaaggttttaggtgcatttagtagtaaagggaggaggagataaaattgagaaagcaaacagaatctgcctttttgactttgtgcttaaatgcggatgctcctcagcttgtggtggggttgcattctgataaacctatcataagttgaaaatatcattaagtcaaaaattaacacacctaacctaccaaacatcataatttagcctaccctcccttaaatgtactcagaacacttccagtagcccacagttgggcagaatcatctaacacaaagcctattttataataaactattgaatgtttcatgtacattattgaatactgcactgaaagtgaaaagcagaatggttatatgggtactcaaagtgcggtttctacagaatgcgtatcgcttctgcaccatgtaaggttgaaccatttgtaagtctgagaccatttgtataacatacatataggaaagtaaacggggcataagtgaatttttacaaactaaacatactagcactctagaagctcttctcgtggcccttctagtcactacccagcttgctaagggtatccactattctgccttctaaccatagtctacttttaaaataaatttgtcaatggaagttggtagaagggtaaggtagttgttagagagggaattaggggtggagggtatttgttgtgttttgtttaagacgggagagattttcttgaatgtaaataaatgtcataatttctctagtgggtggccagtcactctgtttctttttatatttaggacagttttcattttatactttcaaatgtttttaaaagtatgtttgagtgcttatacaaacttaagttgaataactgttctctaagcatatgtttgtggaatggtggttttcaaaactttgcttatcttgggaatagattcttgggcccctcttagattcagagtcagacactctgggggaagctgttagaatctatgcttttaaaaaattccccaggtgggccaggcgcggtggctgacgcctgtaatcccagcactttgggaggccgaggtgggcggatcacgaggtcagaagattgagaccatcctggctaacacagtgaaaccccgtctctactaaaaatacaaaaaattagccaggcgtggtggctggtgcctgtagtcccagctaccaggaggctgaggcaggagaatggcatgaacccaggaggcggagcttgcagtgagccaagatcgcaccactgcactccagcctgggcgacagagcgaggctctgtcttaaaaaaaaaaaaaaaaaaaaaaaacaactccccaggtgattctgaaacctcttgtgtacacaggcctgcaaaagccttctatcatgaagctggcatatattataaatggaagtctaataagataatagttctgtaattgtgggagaaaagagtcaccctttttttaaatgggagagagtattcactagattctctataaagttgaaaaagaaagcaagttgttaggtatttgagccccaccattcatgagagtctgaataattctgagggtgacttatttagcttaaggtttttatttgtctttaaggcagttttactggaacataatcacaacatgatcccagagctatggaattctgggcagtcagtgtacttttatttgcaaagcaagaacagtttagccttctggacacccattatgatttgtttgtttacgaccttaccagattcatgtcttggtaaactgtgtctaagaatctacctttaaagctgagggagctgactgataaactcaatctttttattttattttattttttgaggcagagtcttgctcagtcactcaggctggaatgcagtgacgcgattatagctcactgcatccttgacctcctgggctcaagtaatcctcccacctcagcctcccaagtagctgagaccataggcatgccccaaacacctggctaatttttttttttttttttgtagagatggagtcttgttatgttgcccaggctggtcttaaacttctggcctcaagtgatcctcccacttcagcctcctaataaactcaatcttatgcctgaatcttttttttttttttttttttttgagatgaaatctcactctgttgcccaagctggagtgcagaggtataattttggctcactgcaacctccaccttccaggttcaaacgattctcttgcctcagcctcccgagtagctgggactacaggcacatgccaccatgcctggctaatttttgtattttagtagagatggagtttcagtgtgttggccaggctggtcttgaactcctgaccttgtgatccacctgcctcggcctcccaaagtggtgggattataggcgtgagccactgtgctgggccctgaatctttttttgaatgttaatttattttttaaattgtggcctgagtctttgattaaattcataagcttcctggaagctctataagagcagggaccttgtctgcttatgtgttttatctgtttagtaccatgtctgacatgatgtgggtgtgcagtaaatatttgtttttgaaataaaaccctggttgacctcttctaattgttatatataaccttgcttgcctgaccagatttgttttgccaacatcagtccttcgcaagcttcagtggagacagagtaagaaccaaatgtctttaagatgatgacagcctacccctttacacttcttgttagggcctcatctaacccaacaccaatactggttgctctgtttccattgacaagccccttgcgggctgtgcgaaacaaaagttttgagacatagagagtctaaggtccaagatagagtgtaccttgatactttgctggggagtaggatcagaccagaaagaaagaagagttagccacaagagtgagaaaactcaatgacactccctctgaggtttgcaaagctaagggccaccagtttacctttaagccaaattttcgttttctctgtgactatgggtcttacagctgtattcaaaacctcagagaagccaacacattagagtccttactttgagacccccaactagctgaatgccaagaaaggcatttagtaactgaagggtatactcccgaggggctggatctaaagaaatgccacctttgatctagcctgtaacttagcactaattggagattcagctcttaacagagcttgcttgactttgattgagcaagcctaactcatataatgcaaagtagaccatatctaatcagttcttggcaggtgcatatgtactcattttctgagccaactcatctgccctgaccagggagtgtacctggcaacaaggcttctcaaggactatcacttgggaaagggagtgctcagggcgtgggtacatgcagtctagagattacagccctgcatcagaaaaagtttgggggaggccgggcacagtggctcatgcctgtaatcccagcactttaggaggccgaggcggacggatcacaaggtgaagagatcaagaccatcctggccaacatggtgaaaccccgtctctgctaaaaatacaaaaattagccgcatgtggtggcgcacacctgtagtcccagctacttgggaggctgaggcaggagaatggcttgaacccaggaggcggaggttgcagtgagccaagatcatgccactgcactccagcctggcgacagagggagactctgtcgcaaaaaaaaaaaaaaaaaaaaaaagggaaaaagaaaaagtatgggggagatttcacttcttgggaggtatattcagtccgattatatcataatgggtcaggactcctcatggagagagaatacctttgtgttcatgtctcacaaagcaacccatccagagtgcgaacaggaggaaagttgataaggctagagatttttttttattatgtcccagaccctgaaagttgattgtgtttcttcaaagaactggattgttcttccttggggagacaaaagattgaagaaggttcatctcctctttgtgcccttacactgtcctggggtgattctacccatcttagcctttcccttcttaaatcctgattttgaataggttggcctgaatactcaatatgagccctaacaaattatgataaccacctggcaggcacacagtgtcgaagatggccatttgtgatgacatctggtctggccagcttcctttttactgttaagagggaaaggtggtgagcatgctgaggcagggtggggtcatctcgcaccaggaggagccccctttgaagctaaaaaggaagatgaatcagccaagatgttgagtgcatcagcttcagccatgtctacctggggaccttttaccaaggctcctcccatgggtttccatcacacagatctataccagttccttaccatggtcaggtgtgtggctggctccttaggaatgagcttggcatggattaggtgtgctagagctgatggattttttaaaaagtctaatttacatagagtgaaatacatagatttttaagttgtacagtcttagttgtacaatttgagctttgacaaatgtatataccttgaataacccataccccaatcaagattgtttcaccccagaaagttcacttgtgccacttctcagtaagtccacttccttccaactcccacctccccggcctagtagtgattgttctggtttctcactatgtttgaggccatgggttttaaaacatacagattttcttcaagtctagatggtgagagatgtcagaaagtaatacttactcaagtaaatcagaggttctcagtgggagagttgctccccaggagacatttggcagtgtctggagatgtttttgactgtcgtgactgggaggaggtgctactggcatctagtgggtagaggctagggatgctgccaaacttcctgcagtgcacaggacagccccacaaagaaggacccaacccaaatgtcagtagtgctgagtttgagaaatcctcgagtaaatcatgtgttctctgcaaactaagaattatggtcctggggagtgttcatttgtaggtctcccaggtctcctggggtgaggtttgctttttctttgttttgtttgcttgtctgttgagagcctgctggaagctgaaaaggccgctgcaggagccagctttctttggtgctaccacccttgtggccacagttcttgctgtggaatgggtatcagggtaggcttagggaggaaaactaataggagaagaggaagaagaagaaaacagtttaggcagtaaagggaggcaggcctagaataatattaaaactagaaaaacaagtaagataagaggggaaggtaaagtagaaattaataattaagaatccaataaaatgttaaaggaaatgagttgagatttaaaatcaaagataggctgagtgtgttggctcacacctgtaatcccagcactttgggaggccaaggcgggaggattgcttgagctcaggagttcgagaccagcttgagtaacatgatgagaccctgtctctgctatatatatatagttatgtatagatatagttatatatttatatatatatataatatatatatttgccgaggctggagtgcagtggcacgatctcggctcactgcaacccctgcctcccagtttcaagcaattctcctgcctcagcctcccgagtagctgggattacaggcgtctgccaccacgcctggctaatttttgtgttttttgtagagactggatttcatcatgttggccaggctggtgtcgaactcccgacctcaggtgatccacccacctcggcctcccaaagtgctgggattacagacgtgagccaccgcacccggccttactgtgctttatgagaaataaatacacccctgaagtgctgaggaagtccagacccaaaaaacatgttcttatggacttaaaatttcaggtcaactttttcttaatttccaaaagacaacagtttctaagtttgcctactttagcttttcaagtaaaataaaagatacatagatagatgactagacctctagctgtctgtcggtctctggaacatgtccaaaaccaactcatcatttttccctcagacttgcccctctttttctacttcctctctcaggaatgctgtgtcaccacccaactagaaaaacccatcggaaaccccaaggtcacttaaaatctactcttttcctgattttcgaaaatccaatacattgttgttaactctagtcattatgttgtacaacagatctcttgaactactcctcctaactgaaactttgtacttttgaccaatatctccccaactccccccagcccttgccctggtagccaccattgtgctctctacttccattagttcaacctttttagattccacaaaaattaatttgtgaggtagtgcatatgttaattagctcaatttagccattccacaatgtacacatatttcaaaacagcatgttgtacacaataaatatacacgattcttgtcagtttaaaaattaaaataaatgaaaataaaaattaaaccaaggtcatcgtcactcttcctttccctttggtcactaagtcctgctaattttgcctattaaactatctcaattctactttctcctctttctcctctcctgtgcaatctttccttgggcccttatttctttccttcattgttttagcagcaccataactggtcagctggccctttaatgacttaaagcgccacactgagaaataatcgtctttctaaatggcaaactcgattctatattccatccttatttgagatcttttggtatttattacctaggacttttatgtgagccacacgagtcccattatgatctggctacaaccaacttctctgactcatctctctgtcactctgctccctcccacaaaactcgaactccctacacttctcccatgctgtttcccagcttcgtggcttcacacatgctgattcctctgtctataatgtcctatacttgttttgtctttctgtagaactgcctaagagccgggagaattcatgcttttgaaacaaggggaatttcccttgtccctcttacagggcatgtgatgggagtgtggcccacttcttaggtgccccactgctcaaaacccctagggaaagcaggcagatgggcaggtcgtggggagtgtgggctccaaccccatggcagcgtctaggggtggatgtttacagcttctgcagccccagtgggcgtgtgttacgtgtgctcttttagttttgctgtcagtaggcagcttgtgttcatcagctcagttagaccctctgccttattgcaaggacagagggctttctgtatcctagggttcttgcctgagtataccagaaaaaccggatcacacgtgggcttggaggatgagtgcaaggttttattgaatggtggaagtagcactcagcagatggaaacggagccagaaggggtatggagtgggaaggtggttttcccctggagtcaggccgcttagcagccaggctctcctctgaccgccctcagccaaactccgcgttgtcctgccgttctgctgttggtggcctgccggagtctgtcactgtgttcttctgctggtatgttgttccttgcctctgcttctcttgacgtccagccgcttgtgtgcctgcccgctagggtctcggggtttttataggcacaagatgggagtgtggtgggccagggtggtcttgggaaatacgatatttgggcacaaaaacagaaatgcctgtcctcacctaggttggtgggcacaggcccaggggtggagccctagccagggaccacgcccttctctacccagcatttccctgcctgcccctcccgtatcacttttcttttatttatttactttttgagacagggtctcgctctgttgcccaggctggagtgcagtggcagtatcttggctcactgcaatctccacctcctgggttcaagcgattcttgtgcctcagcctcccttattttattttttaatctgtcccaggccaagtgcagtggttcacacctataatcccagcactttgggaggccgcggtgggtggatcgtttgaatccaggagtttgagaccagcctgggcaacatggcaaaaccctgtctctacaaaaattacaaaaatgagctggacatggtggtgcatgcctgtagtcccagctatttgggagacaagacaggaggagtgcttgaacctgggatgggaaggttgcagtgcagcagaaatcctgctgctgcactccaacctaggcaacagtgtgagaccctgtgtaaaaaaaaaaaaaaaagtttgtccatttatttacatctatcaagttcttcctaccagaatggaagccctttcagggtgaggatatgtcttactccatattcctatttctatggctgtgcctaacacacaaggcatgctcaataattgtttatttcctgctcaaatgagacaaaaggaaatggatggaggagaggtggaaaataaatgagtgattgatttctctctaactatttaggcatgatttagcatcttggaaatcatattactgagatttgcagtgcctgtaatgtgaaagatgaggctattctgtaatacaaaacgtaatgccagctaaaatataacaaaaatatctgttgaaacgtatggctgcaaattcccatatttcagaagcaaataaagagctgaaagccattaagaaaaaaaagggtggttgttactttaactggtttaaaaacaattgatacatcttgaagtattaagtgtgcatcttgaggtcttaatttcaatgcagttttgctacagatttcttttgcttccacgatacagattagccagctagtgctgacattagttcatgtggtttgtgcccatcacaattattaggcagaaccagcagcaccaggatacaacctaaggagatcaacgtccctcctagaaaactgccacggccttcgcaggaggggtctgaatttttttttttttttttttttttttttttgaggtggagtctcgcactgtcacccaggctggagtgcggtggcacaatcttggttcactgcaacctccacctcccaggtgcaggtgattctcctgcttcagccttctgtgtagctgggattacaggtgcccgccaccacgcccagctaattttttttttttttttgtaattttagtagagacgggatttcactatgttggccaggctggtctcgaatgcctgacctggtgatccacccacccgcctctgccttccaaagtgctgggattacaggcgtgagccactgcgtccagcacattttttatattcacaattaaattaataaaccataactctcctcctctcagcccatctttttttttttttttttttttttttttttttagtggagcgattattttgtgtgtgtgaaacagagtctcactctattgcccaggctggagtgtagtggcatgatcatggctcactgaagcctcaaactcaagagttctcccacctcagtctcctgagtagctgggactacaggcacacaccaccatgcctggctgattttttaaaaaaatatattttgtaggccaggtgcactggctcacacctgtaatctcagcactttgggaggccgaggcgggcgaattacctgaagtcgggagttcgagaccagcctggccaacatggcaaatccccatctctactaaaaatacaaaaattagccgggtgtggtggcagacgcctgtaatcccagctacttgggaggctgaggtagaagaatcgcttgaacctgggcgttggaggttgcagtgagctgagatcacgccactacaccgcagcctgggtaacagagcaagactccatcttgaaaacataaaaataaataaaaataaaataaagcacagtaagcctttcagggtggggagtggctgaggttatgaatatgctcatgttctgcacattcggtctgtaacatagagaggtttaagattgcttctgcatttcaggtaattcagaggtccgtggggccagccagcctgagcttgctcaccttcaaagtctatgcagcaccaaaaaaggactcacctcccaaaaattccgtgaaggttgatgaggtaacatgttgttcatgttgcgatatattttgagtgtctgatttagttactgtaggataattttttacaaattgtatatcaggaagatgtgactgtttaaaatacatttatttatttatttatttatttatttatttatttattttgagacggagtttcgctcttgttgcccaggctggagtgcaatggtgcgatctcggctcattgcaacctcctcctcctggttcaagccattctcctgcctcagcctcccaagtagctgggattataggcatgtgccaccacgcctggctaattttgtatttttagtagagacaaggtttcaccatgttggccaggctagtctcgaactcccgacctcaggtgatccacctgcctcggcctcccaaagtgctgggattacaagcgtgagccaccacgcccagccagaagacatttaaacagagaaaatatatttccttatagtttgtttaatttgtgggaaatattaaactatggctttttcaacagataaactttaatgatacttaggtaagggcacaattaaggaatactttataaatgtttactggggaatccactgtgtcccaacaggttataagcacaactcacttttctaagtggtctgcctgattcttggcttatcttgattcttatcgagccaagaatatattcacattttttcctctctaagaaattagagatctggatcctttctgtttcttggctagaggagccgctcataagtatgtacttaataaatactaaatttaaaaaaaaaaaaaacaagaaatcttctctctactgtttacattcctttttggtctgtacttcccactaattattttggatattcagtttctgttgcctttgaataaagtgaggtaaggatctaccttcagtcctgggtagggttactagattggtgtttacataaagctaattagcttatcttttgccctttactcgcttctcaggccttggcacagtggcatttttgagggtaaagaaggcagccagcagtggctgtaagaagttctctgggtggagaataaacctgctgtcctgctttgattaacatcagaccaatcatttgaactgaatgacatgccctttggttactctcaagcttttttaaccccttcacccaccctttagagtaataaaatcttttttccaagctcaatctaaggtggaataccaaataccagtatataaaatggataaagaggagctgctttgtttgtagtcagtgggtggggagaaagtaggacacctcatagccctgcccttttggccttggcctcgttgattatggaaataaggtgcagagatagtttgagataaagttcaggttgcttgtaacccttagagtcactggaattcatgaagtattattattattatttttgagatggagtctcactcttgcctaggcttgagtgcactggcacaatcttggcttactgctacctccacctcccaggttcaagagattctcccgcctcagcctcccaagtagctgggattacaggcgcctaccgcgacacctggctaagttttgtatttttagtagagactgggtttcgccatgttggctaggctggtctcgaactcctgaccttaagtgatccgcctgccctggcttctcaaagtgctgggattacaagcgtgaaccaccacacccgaccacagagtcactgtaattcatgaattactagaaatattatattaaatacttacaaatttgataaatgtatcctgtagacagtacatcttttaaatctttgttttgttttaatgtgcgcagctttcactctactcagttcctgagggtcaatcgaagtatgtggaggaggcaaggagccagcttgaagaaagcatctcacagctccgacactattgcgagccatacacaacctggtgtcaggtacaactgttctgaaaatggagtgaacgcatttctgtttagagtccatagaggaaagtctgtattggctgcatgtttttggaaaaaggcatgataaagggccctgagatggttgacagaggctgggaagggtagtgggggtctgggggaaaggtggggatggctaatgggtgcaaaaaaaaaaaatagcaagtagcaagaatgaataaaacctatttgatagcacaacaggatgactgtagtcaacaataatttaattgtacattttaaaataacttaaagagtgtaattggattgtttttaacactaaggataaatgcttgagcggatagattccgcattctccatattgtgcttatttcacattgcatgcctgtgtcaacacatctcatgtgccccataaatgtatatacctactacgtacccacaaaaaatgttgaaatacaaggccccaagttaaaagtgcctgacttacagatgttcttcagtgccatctgaggaggggttgcagagatgccctagcttcctggtgacagctgttgccacagctacagagagaatttccctctccctgggcagtgcgtaacgccttaactagagagcagaggggctaggaactaccttgttgcttgcagttatgaaaacattgttgtctaccaggggaggcttgtgggctggaactctaaacaaaggaaaaagatgcaacgtaaacacttacataaaaattgcgaagtttttctccccccactatacaaatcagtgccacttaaaccaggaggggatatggcattttgaatgctatactaaaatagggtagaattccatactggattactgaactatttgttctagtgaccaaagaactacatatacagattggtttctgtccctgcctgggttttaggtcaggcatttgtcattacgtaaatgaaaagtatttctgtgatttttaacatcagtaaccaacgtttacaatctatagaatgcttttgtaggctttgatacatatgtttgttgtacttgatcttgattttgaaaattgaaattaataaaaactaatagatgtagatatgtgggaaattgtctagatttaccttgcttgagatttataaatttagtctttttgtttttttttttttttgagagggagtcttgctctgtcgcccaggctggagtgcagtagcgtgctctcagctcactgcaacctccacctcccgggttcaagcagttctcccgcctcagcctcccaagtagctgggattacaggcacgagctaccatgcctggctcatttttgtatttatcgtagaggcagagtttcgccatgttggccaggctgatgtcgaactcctgacctcaagtgatctgtccaccttggcctcccaaagtgctgggattacaggcgtgagccaccatgcctggcctaaattcaattttgatccagagcttgtttaaaaatttttaatttccgttgcctatgctgctgttgaacttttgttcaccaatttagaaagaaaatagtaaagcatggactctatcaacaataagaattaggccattatacttaagtatcataaccatattattgagttaagtaatacctaaagactttaaacataacatgttgtaaaatgattagactttattctcttgttctagaagatttttaaacttctggtagttaagataaagtcagcaaatttgtgtgtatatttttgtatcatgtaggcatgactactgttacttgtagtctgtctgttttttttgtttgtttgtttggtttttttggcaataaaagtactttgtaccttttagcctaaggttgctttttgttttttaccttttcttccatgcgtgatactcagtgcagcaaaatacctctctggatgatggattagttatctatatgtttatttccactactactaaatataaaaacttgcttgtaattataatagtttttgtaattataatggttttgttttcctgggtagaacaaagcctttatgagtagaaatatttctaattcctggttcctttttcagaccagcaatttctagcccttttcttgaagaaccaatttaattttgtttttttgttctttgtttttctttttttgagacggagtctcgctctgttgccaggctggagtgcagtggtgcagtctcagctcactgcaacctccgcctcccgggttcaggtgattctcctgcctcagcttcctgagtggctgggactacaggcgtgtgctaccaagcccagataatttttgtatttttagtagagacggggtttcaccatgttggccaggatggtcttgatctcttgaccttgtgatccgtccacctcggcctcccaaggtgctgggattacaggcatgacccactgtgcccggccttaattttttttaatagtaaaaatattaagctagcaaaagaagtcggcaatcattctagatattgatctgaagttttttcttttttttttttttttttggtagagacaaggtttcaccatgttgcccgggctgatctcgaactcctgggctcaagagatctgcccacctcagcctcccaagtagctcggacatcatacacataccaccatgcccaactaatatttttatttttatttttattttttttatttttttgagacggagtctcgctctgtcccccaggctggagtgcagtggcgcgatctcggctcaccgcaagcaccgcctctgggttcacgccattctcctgcctcagcctcccgagtagctgagactacaggtgcctgccaccacgcccggctaatttttttgtatttctagtagagaccaggtttcactgtgttagccaggatggtctcgatctcctgacttcgtgatccacctgccttggcctcccaaagtgctgggattacagccgtgagccaccgtgcccagcctaatatttttatttttttgtagagatggggtctctgctgtgttgcccaagctggttctcaaattcctgacctcacgagatactcctgtcttagcctcccaaagtgttgggattacaggcgtgaaataatggattttaatgaagcgatactcagttctttagatcttctggctaattcggcatttattatttcaggtcatttaaaagaatgaggatagcttgttctgacttgaactgaattacacaaaacaaatccttttccaggccgggcgcagtagctcacgcctgtaatcccagcagtttgggaggccaaggcaggtggatcacctgaggtcaggagtttgagaccagcctggccaacatagcgaaaccctgtccctaccaaaaatacaaaaattagttgggcgtggtggcgggcacctgtaatcccagctactcgggaggctgaggcaggagtaatcacttgaatccaggaggcggaggttgcagtgagccgaggtcgcgccactgcactccagcctgggcgacaaaagcgaaactctatctcaaaaaaaaaaaaattaattaataaaaataaaaataaaaaaaaaatcctttcccaaatggcaactagttttgataccttctgatacccatgtatctcttcttgtcttcactgtagacttcttgaaggtgggtaccttctagcgggtccctcgtttcctttaggatcatgtgatattcatgtacaaagccttttttttttttgagacacgcccaggctggagtgcagtggcgccatctcggctcactgcaacctccgcctcctggattgaagtgattctcctgcctcagcctcccgagtagctgggactacaggcgcgtgccaccacgcccggctaatttttgtatttttagtagagacagggtttcaccatgttggtcaggctggtctccaactcctgacctcaggtgatctgccccactcggcctcccaaagtgctgggattacaggagtgagccatcatgcctggccacaaagcctttttattgtttttaagagaatgttgacacctcatttgctttgggctatagcctttgtctcattaaagctggtcattcttgcttcaaatgggcagtttccagatgtaggctctaattaatggcagatcaggaagtagttaatatgaaagacaggtttaatctcatggagaaaagcttgccacttaaatatcaaggggattgatttttagtctattttttccattttaatggaagagtgaaatggctggattgttgaaaccactctgtttggaatctgcttcctgtggcagtagtaagccattctgctgagtaatttgcagtgaagggaagattataataggaaaaacaaacaaaaagacccagacagacagtgtatccctttgttcaaaaagcgttaataacatgataatttattcagtaaaaacaagtatatttattctgttaactttctaatcagcagatcctgtgaatagtttcattcagtttctttttacctttttaggaaacgtactcccaaactaagcccaagatgcaaagtttggttcaatgggggttaggtaagttgattttaaattaggcataatcagctacttcattaacattgaactctttaatcggagttccatgaatgagctccaagaaatctgtgtattccttaaaattatatgcagaattttagagctatgtggatttttctgggaagaggagctgttgttttcatcagatttcaggcaactagtgtccccaaatagtcaggtaagtctcttcaagatcgttaggattcttgggctagcaagtacagatacactgctttaaaaaaaagaaatctcatttctaggtgcagcgtaatacaccatactaattcatcaatagattttctgaatcggaatagctcatttgcattgcaattaatagatgctctagaagttttgaagcaggaaggagctgagttggtactcctataaaaggtcttactgcataattgatagtgttcttacttttttttcatttggttttattttccttgattatttttcagttgtgggccacttatcacatacactcacaaactggattcacagtccatgttctgactaatcttaatcagaaactggtaaattaataaagataccgatcatatttcattccccttattaggcatctcgcaaacaaaatcttgtttttacaagggtttgtttccatgatagaacaaaataaacataagtacagtttctttggtaagatcaccatggtgtattgatgtcctgatatttctgagactgtcagataaatttatcgtttgaagacaaacataacaatagctgcctactggttttttgtttttttttttttgagacaaaatatcactctgtcacccaggctagagtgcagtggcatagtctcagctcactgatacctttgtctctcaggttcaagcgattctcccaccttagcttcccgagtagctaggattacaagcgtgtgccaccacatccacctagtttttgtatttttagtagagacagggtttcaccttgttagccgggctggtctcaaactcctgacctcaagtgatctgcccgcctcggcccaaaatattgggattacaggcgtgagccaccgtacctggccccctactggttctttaaattattaaggcatgttaataagtaacatcttaattttattaatttcataaacacttatttaagacttatatgtcaggtactattctaagtgctttacaaataccaatttattgggggtggagtgaggatggttaatgagtacaaaaatatagttagaatgaataagacctagtatttgatagcacagtagggtgactgcagtcaataatactttattatacattttattttttattattttatttattttttatttttttgagacagattctcactctgttgcccaggctggagtgcagtggtgctatcttggctcactgcaacctctgcctcccaggttcaagcaattctcctgtctcagcctcccgagtagctaggactgcaggcacacgccaccacacccagcctattttttgtatttttagtagagacgggtttcaccatattggtcaggctggtgtagaactcctgacctcaggcgatccacccacctcagccccccaaagtgctgggattacaggtgtgagccaccgcgcctagcttattgtacattttaaataactaaaaaagctatactcttttaggtattgtaaataaactgaaagagtataattgggatgcttgtaacacaaagaaaaatgataaatgcttgaggtaaaggatacttcatttaccctgatgtgattattatgcattgtatgcctgaaccaaaatacctcatttaccccgtaaatatatacacctactatgtacccacaaaaattttatatatatatatatatatatataaattctcataacaagctgacagataccttattatcttcatttttatccgaggaaactagagaactcctgatatagtcttttatctgtccatgtgtggctgagaggtctcttgtttaaatttttctgagacaggatctttctctgtcatccaggctggaatccagtggcgtgatcatagctcactgcagcctcaacctcctgggctcaagcaatccttccagctcagcctcccgagtagctaggattacaggcatgtgccatcacattttttccactttttgtagaggcagggtctcacttttttgcccagactccgtacagtcttaaaacatatcttctttcccctttctttgtgatttacccactttggcccagctcaccagagccatctgggtgtccctctgtcaactgctctgtgtacacatctagaattgagcaacactgggctagtaggcaaaaataaagggaagtaaaaaattgcctcaaatgacccagactagaggatggaaagtaaaaactaggctaaaggcaaaataagtaacaggccagacagtaattaatgcaaacataatacaagtcctatagtagtatttaaaatgatcacatttcccaaagaacccaggaaaaggaaaactggcgtgtatctggtattacttaggggacagaattgctgagttttccagtttattagttcagttctgtatatattttttaagtcaccattctgccaggcctcgaaaattgagattggttaagacagtggtcacaaccactgagatgcgtgtaatatattattcagtactagtgcaaatacagagataatcacagaccattattgaaggtacagaggaaggagattagtttaattgaaatcgaggaggtgggagcagtcagggaaggacttctgaagtgaatcttgaaggagcagtgttagccactccaaaatgtgggggtgggactgctggaagcaggcattgcacactgggcccagcatgatcaggcttagaggtgtgacttggtattggatgtttgaggaaccctaagtagatagggagtgctgaagatgagattgagaaggagacatgagggctttgtgtaagtcatgacctagctaaaattcatttgttaattcatccagtatttttttttttttttttttgagacggagtcttgctctgtcgcacaggctggagtgcagtggcgcggtctcggctcactacaagctccgcctcctgggtttacgccattctcctgcctcagcctcccgagtagctgggactacaggcgcctgccaccacacctggctaattttttttttttttttggtatttttagtagagttggggtttcaccatgttagccaggatggaatacatccagtatttatcaactcctggcagtgtgatttttgtttttttgtttttttgttttttgagacagagtctcgctctgttgcccaggctggagtgcaatggtgtgatctcggctcactgcaacctctgcctcccaggttcaagcgattctcctgcctcagcctcctgagtagctgggattacaggcacacgccaccacgcctggctaatttttgtatttttagtagagacggggtttcaccatgttggtcaagctggtctcgaattcctgaccttgtgatctgcctgcatcggcctcccaaagtgctgggattacaggcgtgaaccactgcgcctggcctgtttttgtttttgtttggagacagggtctcattcagtcacctaggctggagtgtagtggcatgatcatagctcattgcagtcttgacttcctggactcaagcaatcctcccacctcagcctcccaagtagctgggaccacagacatgcatcaccacacctggctaatttttttttttaattttttgtagagacagggtttcgccatgttgcccaggctgttcttgaactcctggactcaagcaatcctcccaccttggcctcccaaagtgctgggattacaggcgtgaaccactacacccagccatcattcttaataaatatctattgaatgaacatccattattaccactgagggaagataacacagaagtgtaagcaatctatcattaaggagcttacattctccttggggagacaccagatatacacctgaataattaaacacagggtactataggattaggtaccaagtgatggtacagagaataaatatgatgggactttagaggagggagagaggtgtgaactgatgagcttaggaaaggcttttgtgtggaagtaggactcaacttggcttttatgaggtgggattggctcagtggagaggagacgaggcattatgtgaatgaagtcagaaggcatgttcagtcatgatgaataggtcacatgttgtatttatttttattctatcaccatcaacagcgatcaacagtggctattttctgagtgaaattacaagtttcctttattatccaaatttattctgttcttctgttcgagtaatgagttcagatggcaaaggatgcttatttttctgagtctaatgtatttgatttctttcttttttttttttttgagaaggagtctcgctctgtcacccatgctggagtgcagtggcgcgatcttggctcactgcaacctccacctctcgggttcaaatgattctcctgcctcagcctcctgagtagctgggattacaggagcgtgccaccacgcccagctaatttttttgtatttttagtagagatggggttttaccatgttggtcaggctggtctcgaactcctgacctcgtgatccgccctcctcggcctcccaaagtgctgggattacaggagtgagccaccgcacctggccttcctttttttttttttttttttttttttctttttaagaggctgtgtcttgctctgtggctcaggctgtcaggctgtcaggctggagtgcagtggctcaatcctagctcaccgcagccttgaactcctgggctcaaatgattcttctgccttagccttggaaagtgctgagtttataggaatgagccaccactcacagcttgtttttggttcctgagtttcagagagcaagcagcaaagcttcagatagcaatagatctatccaaagatttatccaaatctattctgtttttgtgtttccataacaagagtttgaatagcaaaggatccctgtatttgtattcctccctgtgcaaattgctgattcagatctgttgctttcaggaatatgaaagtaatttaacatttacttcattgtcagtaggttgttggaccaaaggtacttgaaaattggacacttgcagccgggcgcagtggctcacacctgtaatcccagcactttgggaggctaaggcgggtagatcacctgaggtcaggagttcgagaccagcctggccaacatggtgaaaccccatctctactaaaaatacaaaagttagctgggcgtggtggcgggcgcttgtaatcccagctacttgggaggctgaggcaggagaattgcttgaacctgggaggcagaggttgcagtgagccgagatcacgccattgcacaccagcctgggcgacaagagcaaaacttcatctcaaaaaaaaaaaaaaagaaagaaaagaaaattggacacttgctatgtgaatagtaaatcttgtttatatgtcacataaaaagagtatgttgaagagaagtatagtagcaggatgcagagaatatgtggtttgaaaagcacttgatactatatatacatattatatactgtataagacttttgttttgttttttaatgagaaatttatggaactgcttcctggtctaattctattgtagacagctatgactatctccaaaatgcacctcctggattttttccgagacttggtgttattggttttgctggccttattggactccttttggctagaggtaggtgcaattttatggctttaacagtcagctcataaagcagagatagaatatatgtttcattctttcccttcatttaccaggtttcagaataatgagttggttcctaaatacggctttcttaatgtataatggatatggttatcatatttgattttaaacataaatagaaattgtatactcttggtaaaaaaaagaagttatcctttataggcacatttacttgatcaaatctctgttgttctttggtacagaaagagcaaaattttaaagtctttcacacctgagaaatcaactgtttctaaacgtttcactattaagatcaagctatattaatcacagtagatagagcagtgatttaatagagattttattaccttcttgatttgtcatgccttcagtcagtgatgacaaaaactttaaaaatgctttaaatactaacaaatgccaacttaaaaatattactatactgctagattataaaatatctataggaaataaaggctaataaaatactttgctatgatgagatgaatttgttatcaactacttgaagttttgctagttggaaactaaatgtttatgatataaaattctgacattaccatcattcctaatgaagaaagtttatgaatcctgtaatcagacccctgtaaaagagaaccatagagactactctggtccctgtattagtttgttttgcattgctataaaggaatatctgaggctgggtaattataaagaaaagagatgccaggcgcagtggctcacgcctgtaatcccagcactttgggaggccgaggcaggtggatcacaaggtcaggagatcgagaccatcctggctaacacggtgaaaccccgtctctactaaaaatgcaaaaaattagccgggtgtggtggcaggtgtctgtagtcccagctactcgggaggctgaggcaggagaacggtgtgaacctgggagacggggcttgcagtgagctgagttcgagccactgcacttcagcctgggcgacagtgcgagactccgtctcaaaagaaaaaaaaaagaggtttatttggcttatggttctgcaagctgtacaagaagcgtggcatcagcatctatttctgttgagggtttcagaaagcttccaatcgtggtggaaggcaaagggggagcaggcgcatcacatggtgagagagggagctagagagatgccaggctcttttaaacaaccagccctcatgttaactaatagagtgagaaatcactcattcccacagggagggcaccaagccattcatgagggatccacccccatgacccaaacacctcccagcgtgggggttcacatttcaacatgagatttaaaggggacaatcattcaaactgtatcagtcctattcctccaatttaaaaaatcttccctctacatgcaatagcttttactttagtttagtttagtttcgtttcgtttcgtttcgtttcgtttcgtttcgtttagcttaatttgagatagagtctcactctgtcgcccaggctggagtgcagtggcacaatctcggctcactgcaccctccgcctcctgggttcaagtgattctcctgcctcagcctcccaaatagctgggattatagatgtgcaccaccacgcccaactaatttttgtatttttagtagagatggggtttcgccatgttagccaggctggtctccagctcctgacctcaagtgatcggcctgcctcggtgtcccaaagtgctgggattacaggtgtgagccactacacctggccttattttttttttaattgatttcttttttgagacagggtctcactctgtcacccaggctggagtgaagtggtgtgatcatagctcattgcagcctggacctcctgggctcaagtgatcctctcaccttagcctttcaagtagctgggattacaggcgcctgccaccatgcccaggtaatttttgtatttttagtagagacggagtttcgctatgttgctcaggctgaactcctgaactcttgaactcttgaactcctgaactcaagccatccacctcccttggtgtcccccaaagtgctgggattataggcatgagctgccgcacccagctaatggctgttatttttgaatctggagggtagacactgccctggtggcactaccagctcacctgtggaagcaactcatgtcacagtctttgtgccctcctcccatctcatgcagaatatgtcagaattaaatttccagcttatttttgtaatcaacttatgaaccaacatttttccctaaacttctttcacctcatttcttgcaaagctgttcagaagagcattcggtcttatttagatagcgtttgagattgatgaacatcccaaggccagggtgttgggatttcagctatcgttagggagataggaatgtagaagtgagtgagaggagcttccccctccctctcctggttagagcatgtgggaaaatcttccaggtccaaagaaagcactttttctgtgctgtgggtacgttcctacagtgccgagagcttgtccctggaacatccactaggatgaccatcctaaggaggattggagatggtgctctcctggccagagcagcagcatgaggacatctgctacagtgggtcctagtcctctgattttgtttgttcgttctgtctcttttcttccttttcctggggagagcttggtagtattaaaataatttgacaccttaattctttttcacaaatattcacacaggcacgcacacacacatgtgcaatagcaggtcttttctcctgagcgttgggtatagaaagacctgaggtgagcagcatcagaggggttcaccaagcaagatgagtggggtgatagggatgtctgtgggtagccagaatggtttgcaggcccctccaggtgaatgggcccctttgagggcagcagcagggtgggtgggtgcagaaggtccctcctgataggagtttcttttttttttttttgagacagtcttgctctgttgccgagactggagtgcagtggcgccatctcagcctcactgcaaccctgcctcctgggttcgggtgattctcctgcctcagcctcccgagtagctgggactacaggcgtgcaccaccatgcccagctcatttttgtatttttagtagacacgaggtttcaccatgttgaccaggcttgtctcgaactcctgacctcaagtgatcctcccacctcagcctcccaaagtgctgggatcatagttgtgagccactgtgcctggcctggtggggtttcttgagcgtatctgctaaggtagtctgcttcagttgttgaggattgccacaactgtggtggtgacaagaggctctcagagaggtgaatggatgtccattcagaggaagtgggcccagccagaccactccaagatgacacgtggttgttgacactattgttgccttctggtggctctccccagcattggccaccagtggttccccccgcccctggcagtgctgatagtgacaacctgtaccactggcctcttgggagatagggcatggaggtgggggcaggggagtatgattacacctccttcctgaagttcttgggtctctggctcattgtgtgaaccagcaggagctggaggcccgagagctgccacttctcggctctccctggaggagtgagaaatgactgggtggcaggttggctgctctttccctggtcctcacttgggtgagctgcttcaagtggatgggggcaggggaggggccatatgcagggatatcacaggcttttctcttctaggataattataccctttcaattcatgcaacaggatcaggagagaaacagtaaatcattaatagtctaggttgataacatttgtattctcttcagcagtcccagttccatcgttggggatttctctgtttaaagttttaaagccaataaacagtacttatgtgattagaaccgtttaaggattaatgtacacattctgtcggggtacagtggctcacacctgtaatcccagcacttcagaagttcaaggcggatgtatcacctgaggtcaggagttcaagactagcctagccaacatggtgaaacccgtctctactaaaaatacaaacattagccaggcgtggtggcgggtgcctgtaatcccagctacttgggaggcgaaagcaggagaatcacttgaacccgggaggcagaggttgcagcaagccgagatcgcaccactgcactccagcctgagcaacagagcgagaccccatctcaaaacaaacaaacaaacaaacaaatcagccgggtatggtggctaacacctgtaatcccagcactttgggaggctgaggtgggtggatcacctgaggtcaggagttcgagaccagactgaccaacatagtgaaaccctgtctctactaaaaatacaaaattatttgggcatggtggcgcatacctgtaatcccagattcttgggaggctgaggcaggagaatcacttgaacccaagaggtggagattgcagtgagccgagattgcaccattgcactccagcctgggcagcaagagcaaaactccatctcaaaaaaaaaaaaaaaaatcaataacacacacattctgctagcatctatatgggtcccacagcaaaaaacactatgcctctcagtggagtcaaggccatgtgtattctctagtttcatcctctactggtttttttaacctcattctcaggtttctccaggctctgtgtcctgctgtctcttctgtccatttcccttgctccacagctctatatcctcctacaatctggcctgagacttcaacacagttcttgttttgggactggtcttcttcacactttcttgggtttaagcccccttttcctgggttccatgtcatcttctccttggtttactctgccgtgctgttgaactacatgcttaagtcactttcaaaaaagcgtatgttggaggtaaacttcccaagaccttccatgtctgaaaatcactttctgccctcataccatgtgacagtttggttgggcactgaattttgtttgccatcaaaactttcaaagccatgtattctagcatctggcgttgtagatgtgagagtcagtagccattctggatatttgctgcttctgaacaggtgatacattttttttttcttcctggaagctttgaagatcttctgtgaatctttagtgttctgaatttctttggtgctgtgactagatagaagtcttttctttttttttgagacggagtctcactctgtcacccaggctggagtgcagtgtcacaatctccgctcactgcaacctcctccacctctgggttcaagtgattctcacgcctcaacctcccagttagctgggattacaggcgtgcaccaccacgcctggctaatttttgtggttttagtagagatggggtttcaccatgttggccaggctggtcttgaactcctgacctccagtgatccacccgcctcagcctcccaaagtgctgggattacaggcatgagccaccatgcccagccttggatatagtgttttcattcttgcccaaacaatatggcggcttgcagcatccagctgaaggaaaatatcttcttttcctccctccctccctccttctcccttccctgccctcccctccctctctccccttccctccttctccctccccttccctcctccctccccttccatcccctgcatccctccctcccctccctccttctcccttcccttccctccttcttccttcccttctcgtcccgtccctttctcttctcttctcttctcttttctttctgagagatgatctcactctgtcacccaggttgtagtgcagtggcatgatcagggctcactgcagtcttgacctcctcaggctcaagcaatcctcccatctcagcctcctgagtagctgcgactataggcatgcaccaccacacctgactaatttttttttttgtggagaccgggtgtcaccatgttgcccaggctggtctcaaactcccgagctcaagcagtcttccttcttcagcctcccaaagcgctaggattataggcatgagccactgcgcccagcctatcttgtgtatctttgaaaatttactctcattctttttccttcctcaacgcattaattagcaattgagttatttaaaaggaccctatgtgtctcttatattttcttgattattttattttgttccttttgaattttttttgctttggtcatttccaagagctccttcctgttctttgaatgttctttttttcatagaattatttttttcttttaatgtagtggcttttaaaatttatttgatgatacttagtaataggtttagttttgttttgaagttcttctgtttcctttgtgcttgtcttggtctttctcctttatgtttcaggctttccacaaatgactggtgattcttggttatccagtcatgtttcaaagtgaggcagctgaaatgctaataagaactctttcacctgtaatcccagcactttgggaggctgaggcaggcggatcacctgaggtcaggagttcaagaccagcctggccaacatgggaaaaccccatctctactaaaaatacaaaaaatagccgggtgtggtggagggtgtctgtaatcctagctactcaggaggctgaggctagagaatcacttgaacccaggaggcagaggttgcagtgagctgagatcacgccactgcactccaacctgagcaacagagcaagactccgtctcgggaaaaaaaaaaaaaaaaaaaaaagaactccctgtctgtacatggggcccactgacgggcaggttctacctcaggggagctgggcaggaagtgaccatatacaagggtgcacccagggccagtgtgaggagggcttttctctcaggcactgacatactcaccccttccagctctcttggttctcagcaggaaatccatggtgtttctttagtgataccctgcccccactgttttaactcttttttttttttttttttttttgagacaggatcttgctttatcacccaatgtgttaggccattcttgcattgctataacctaacactgggtaatttataaagaaaagaggtttagttggctcacagttctgcaggctgtacaggaagcatggcaccagcatctcctcggcttctggtgaggccttgggctgcttgcaatcatggtggaaggcaaagggggagctggtgtctcacatggcaagagtgcgagcaagagaaagaggtgggggaggtgtcacacatttttaaacaaccagatctcaagagaactcactgttgcacaaggacagcaccaagggaatggtgttaaaccatctgtgagaaatccaccttcatgatcaggtcacgtcccaccaggccccacctccaacattggggattacaatttaacatgagattcagagagaacaacatccaaattatcacccaggctggagtgcagtggcatagacacagctcacagtagccttgaactcctgggctcaagcaatcctccagcctcagcctcctgagtagctaggaccacaggcacatgccaccacaccttactaattttttaattttttgtagagatgtggtctccctaagttgcccaggctggtctcaaactcctgggctcaatcagtcctcccacctcagcctcccaaagtgctgggattacaggtgtgagccactgcatcaggctcattttttttttttttttaaaggaatagagatggggggctgggcgtactggctcatgcctgtgatcccagcactttgggaggctgaggcaggtggattgcttgagctcaggagttcaagaccaacctgggcaacatgaggaaaccccgtgtctacaaaaactacagaaaaaaaaaaaattagccaggcatgatggcttgcacctcttgtcccacctacttgaggggctgaggcaggaagatagtttgaacctgggaggtcgaggctgcagtgagccatgattgtgccactgcactccagcctgggagaccgagtgaggccctctctcaacagaaaaaaaagaaatggagatggagtctcgctatgttactccagctggtctcaattcctggcctcaagcaatccttatgcctcgacctccccaagtgctaggattacaggtgtgagccaccacacccagtaaccctggtttactgggttttttaacattttgaactggtgtgacttcctggccaggggtagttttgtactgggatggcataggggaaggaaaggccatgctggtccatgcatcggacttgcgtttgtcctgtgcccttgtcttgctccctggttgccatctccactccccatggtacctgccatctctggatctggaatctccctggggctgcctgggacagatctgctccctctgaggctgcactcctcctcaagatttcaagatttcaaggcagtgtgtcctcttatttccgttcactctccattttctgaaaattgattgacacttcctttctgccagtggcccttccacacattttctcttcattgtgggtttattaatgttttttcttactgtttttttaacggggttgcagaaaggggagaagaagaacgcttgtgtttagtatttatataggaagccagattgctataaaagaacataaaccctagaaaccaaaatactcatttgtttatttttaaaataatctttttttctgctctcttagggaaaaaaaggtgttcttttgaaaacacttggtgctgagtgaaagaagccagtcacaaaggaccgtatatttactgcatgattccatttatatgaaatacccagagggccgggcgcagcggcttacacctgtaatcccagcactttgggaggccgtggcgggtggatcacctgaggtcaggagttcgagaccagcctggccagcatggcgaaaccccatgcctactaaaaatacaaaattagccgggcatggtggcgtgtgcctgtaaccccagctactcgagaggctgaggcaagagaattgcctgaacccgagaggcagaggttgcagtgagccaagattgcgccattgcactccagcctgggtgacaagagcaaaactctgtctcaaaaaaaaaaaaaagaaatatccagagtaggcaaacacatagagatagaaagtagatcaatggttgcctagggctggacggtacgggggagttgaggaatgactgctaatgggtttcttttagtgattatgaaaaagctctaaagttaattgtaatgatggttacacacctctgtcaatatactaaaagccattgaactgtactttaaatgggtgaatatgaattttatctcaataaagcagtgcaaaagcgttttggtgcacatgactttatttggcacattctttcagtttaggaccaaagaaatcttattcagtggtggggttattttggttttgttgtttgggtttcttaagagacacggtcttgctctgtcacccaggctggagtttagaggtgtgatcatagctcattgtaacctcgaactcctgggatcaaggaatcctcccacctcagcctcccaagtagctaggactataggcacacactaccacgcctggctaatttttttattttaatctttgtagagacaggatctgactatgttgcccaggctggtgtcaaactcctggcctcaagtgatcctcccgcctcggcctcccagagcttttggattataggcgtgagccactgtgcctggccttgttccgtattaaatggataaggtaaattgtgatggtgaggataatgaatcatctgatggcgtgtacaaccttttatttatcaggttcaaaaataaagaagctagtgtatccgcctggtttcatgggattagctgcctccctctattatccacaacaagccatcgtgtttgcccaggtaagagaaactctgtaatccatgatgtccctcattcttgtttgtgtgtgtatgaatctgatgcttaattttattttattttgcagttcttataacaccagactaaaatttgtttgtacatatagatgaatacagaaaatttaaatgattttctccactatatgcctcagttctggcccttcttccagtaatgccagtgttcacagaatttgaacacgaatttgcgtgattgtttgaatgttcatcagcaaaaatttaatatacattttttgtatacttacatggaagtctagagactcaaattccaaagctgataattatgggtcactcagtttatgcatgtccggtcacaacctgctctcgttggtattgtagacccagactactctgacttccactcctccctagtactggtgcccttgctttccttgctggggactttggggactgtaatcccctctgcttggagtgcccttttcggggctttcagttggctgctcctttcttatccttgaagcctcagtcttatggtaccctggcaagcaggtctatcacggtggcaggcaacatggataaagctgtaccaccgattcttaaaatgtgttaccagaccagaagcagcagcatcacctgagaacttgttagaaatgcaaactctcaggccccaccccagactgactgaatcagaagctctgggagtaagggccagcagtctgtgttttagcaagccctccggtggtttgttattaatgcctatggtgtttgagaaccactgatggagaccagtaggtagcctgaaaagggtgatatctggagtgagtgggactctagagatggtgtccctcaggaactggtaagaacaagacaggctctaggttttgaggtcctgggcagattgtggacacagggactttagctgctggaactaccacatcacatggaaactcagttccaggagcagacagcagtgcagtcacccaaattggactctgagccagactgacctgagactgagcttccttggttgttcatgacagtattgaatccagattccttgattgggctacagttgtatgtgagagtccagtggccccagcttggggagcttgatggctttgatgacaaataccagtactttccagcatttgctcaacattgtttgtaacagtcctggaggcagatagttaatgcttctgtccctgctccagccccaggtcaggaacagtgagtaacatcttccagccctagatataaaaataattaaacattatttcagcctgttatggtttaagcagtaaatagctagagtggagagggtgaacttggttgctcgttgagaagcatatgtggctgtccccagagtaggagtcttttttttttttttttaaatttctttcttttttaacttttagcgttaggtgtacatgtgcaggtttgttattgtaaatcgtgtgtcatgagggtttggtgtacagattattttgttacccgggtaataagcctagtacctgatgggtagttttttgatcctcgccctcttctcaccctccaccctcaagtaggcctcggtctctgttcccttctttgtgtccatgtgttgtcaaggtttagttcccaattacaagtaagaacatgtggtatttggttttctgttcctatgttagttcacttaagataatggcccccagctccatccctgtccctgcaaaggacatgagctcattctttttggctgcatagtattctgtggtgtataagtaccacattttctttatcaagtctaccattggctgggcatgttggcccacgcctgtaatcccagcactttggaaggccgaggtaggtggatcacctgaggccaggagttcgagaccagcctgaccaatgtggtgaaaccctgtctctactaaatacaaaaaattagctgggtgtggtggcacatgcctgtaatcccaactacttgggaggctgaggcaagaaaattgcttgaacccaggaggcagaggttgcagtgagccaagattgcgccattccactccagcctgggcaacaagagcgaaaactccatctcaaaaaaaaaaaaaaaatctaccattgatgggcatttaggttgattccatgttttgctattatgcatagtgctatgatgaacatatgcatgcatatatctttatagtaaaatgatttatattccattattattcccaataatagggattgctgggtcagatggtaagatcttttctattttgttttaaggtcagtggggagagattatatgactggggtttacgaggatatatagtcatagaagatttgtggaaggagaactttcaaaaggtgaggagcatctttttcattatcttccttttggtttaaatatgtggtttctctagggttttgtaaaatatttgataaccctgttgatttattgctttttctgtttgcttctagttctgtctccagctcagatttttcaggtgacctttcttggtagagcagtagaacttctgagtatttggttattatcagcagggccaaataagtggtgaccataaaatgcaatgcattccaccgtagtcttagaccatattttccattatattgtattcctagtttcctctaagtgtagcgtattatttaaaagtcttattgaaactgaattcaaagggaatgtactatgctcccaggaaaaagacataattgagagcctcttcctcttggtttttcacttatcatgagttctgttctttccttagcactgctgtttctgtttatcccccaggcttctcagctcagctgagggtgtgagccatcgtatgttggggactagctaccagctaaaggccacgttctctgtgctgtctagtacatgagcaacagagggaagaagttgtgtaattgtaagaacttgtcacctttcatctcttttagtggccacatagccgattaaatgttgcctatgttcgcttggaacattcccttcctcccactgataaggaagaatgagtagagaataaggtatcatgtctctactaagcactcagaggcacagccagctaaggaagaattagacttcttatattaatataccttctacatcacagattgaaggaagttcatttttcaatgaaaatactttttaaaaaaaaataaataactgagcttcaaatcattgacaagttaaaaaaatacatataaataactatctcagaattaaaatccagaattttgaactgggatttggaagtaacagaataaattataagccctctttattatttacataaataatcttctagtgaaatcttaagactcattttttggccaggtgcagtgactcacgcccagcacattgggagtccaaggtgggaggatcacttgagctcaggagtttgagaccagcctaggcaacatagtgagaccctatctctccaaaaaataaaaaatttagctgggcatggtggcatactttgggaggctgaggtgggaggattgcttgagcccagaaggtaagggctaaatagagtgagccatgattgcgccactgcactccagcttgagcaacacagtgaggccctgtctcaaaaaaaaaaaaaaagaaaaaaagaaaaaaaaccccactaatttttatactggtggtttctaaaggaattagtccttctcgagcctatttaaactagctcttgaataggaaattctataccaatatcaagagtcttttggcaatccctgtttttttgattgttttttgttttatttctctgatattttctatggaagcttcctttcctttttaaaaaattccttaacaaatgcggccaggtgcggtggctcatgcctgtaatcccagcactttgggaggccgaggcgggtggagcacctgaggtcgggagttccagaccagcctggccaacatgatgaaaccctgtctctactaaaaaaatacaaaaattagctgggcatggtgatgcacgtctgtaatcccggctactcaggaggctgaggcaggagaattgcttgaacccaggaggcagaggttgcagtcagccaagattgcgccactgtactctagcctgggcaacagagcgagacttcatctcaaaaaaacaaaaacaaacaagcaaaaaaacaaatgcacactaaattttatatgggaaaggaagtaaaatatcaagaaatctctaaacagccctagacagaaatgtggaaagtgagactaaaagcctcaactgcgagccttcattgtggtgtgactgcagactgaagcacaccaaagccagagggagtcccccaggctccccggagtgctcactgtggtgtctgtgcagacacacacgcacaccaaagctaaagtgagggctgcgggagcctctggcttggaaacagcattctctgactgtgctaagaattcagcccagtgcagaagcagctggactgtggttaggataccagttaagcaggccaacattttctggtcatttgaagacattagatattaaagctacccaaatttatatgcagatctttttagagtgaggtggtaaagatttttaattagctcatgattggtttgcatttctctctgtctttatacccttgccttcttcagagtcattgagaacttaaggctttctcctgtttgttactctccaaggataattttattgacagctgtctgttctcaatagaaggtaataaaatcagggccaggcacagtggctcatgcctgaaatcccagcactttgggaggctgaggcaggcaaatcgctttgagcctaggtgttcgagaccagcttgggcaatatggcaaaaccctgtctctacaaaaactaccaaaaaaaaaataataaccaggtgtggtggcatgcacctgtagtcccatctacttgggaggctgaggcaggagaatctcatgagcccaggaggtagagtttgtggtgagccatgttcaccccactgcactccagcctggtgaatgggagtgaaaccctgtatcaaaaacaaacaaacaaacaaacaaaaaaaaaaaacggtcgggctcggtggctcatgcctgtaatcctagaattttgggaggccgaggtgggcggatcacgaggtcaggagatcgagaccatcctagctaacacggtgaaacctcatctctactaaaaatacaaaaaattaatgttgactgcattaaatatttattacaagttttaaaggaaaaatagcagaaggccctattaattcaaaattcaatattcttaaatttcaggaattacttgatataatgaagtggcattgttttttgttgatcttgcttcaccccccccactttagatttcatgggcttcagggggatttttgttttttattttttggtttatttatttatttttgagatggaatcttgctctgttgcccaggctggagtgcagtggcacgatctcggcttactgcaacctccacctcccgggttcaagccattctcctgtctcaacctcctgagtagctgggactacaggcgcacaccacaacacccagctaatttttgtatttttagtagagacgggttttcaccatgttggtcaggctggcctcgaactcctgaactcaggtgctccacccatctcggcctcccaaagtgctgggattacaggcgtgagccaccacgcccggccttgtttttgtttttttaatgagagctaagatttaagctaccctggaaaatgaatctttctggggccttggagctgagtatattctcttcatagactatcaaataattcaaaatctagtaaaggagataaggaaagcatatgaccaaaatacaagataaaatgtgataaatgccagaagaaaggcacacacaaaaatgtatgatttttggatgaagatatcttgtcttcattgaagggaattaagggacgcttcatgaaggggacttttttgtttcttagcttgttaggaagttggttttcaagtccagctttaattaccagtctcaattaagtatcatctaattcatattttttttttttttgagacagagtctcgctctgtggcccaggctggagcgcagtggcacgatctcggctcactgcaacctccgcctcccgggttcaagcgattctcctgcctcagcctcacgagtagctgggattacaggtacatagtaccacgcctggctaatttttaatagagacggggtttagtatttttagtagagatggggtttcaccatgttgtgcagggtggtcttgatctcctgacctcgtgatctgcccgcctcggcctcccaaagtgctgggattacaggcttgagccaccgtgcccggccaattgtttgtattctaatcatgtaacagatgtactggcttttggttgtacatagtcagagaaactgtggacactatgtttaaaacagggtgctggccaggtgtggtggctcacgcctgtaatcccagcactttgggatgtggagacgggtggatcacttgagcccagaagtttgagaccagcctggacaacatggcgcacccccgtctctactgaaaacacaaaaattagccaggcatggtggcacacacctgtaatcccacctacttgggaggcggaggcacaagaatcacttgaacctgagaggcggaggttacagtgagctgagatcgtgccactgcactccagcctgggcgaaagagcgagactcggtctctaaatacatacatacatacataaaacagggcactgaaaatttttaaattaggaatgatggcacaattcttaacggtattatttcccatgggggtatattactctgaaatatcccaaacaggtctgtggcattttgctgctctgccacatcccttttccctcttacgaaatgattctaaatgtttgtgctgagtcttctaccaataaagtagtgtttcagtctgtcatcattggttacttaagaggaatttatctgcttcagttaaaatgaactttttgtcagaactatgaagcaaagataggtgtgtccagaaatattgtcatcttggtacagtctagggctttcttttaagttacaagaatatataacatatgtatagtttaaaatccaacactataatgaccatgtacataccaaccaattatctacctttaaaactaggaaattaccgtggggcgcggtggctcacgcctgtaatcccagcactgtgggaggccgaggcaggtggatgacgaggtcaggagttcaagaccagcctggccaagatggtgaaaacccgtctctactaaaaataccaaaaaattagccaggcatggtggcaggtgcctgtaatcccagctactcgggaggctgaggcagagaattgcttgaacctgggaggtggaggttacagtgagccaagatcgcgccactgcactccagcctgcgcgacagaacaagactccatctcaaaaaaaaaaaaggaaattaccgatgcctttcaagtcttccatgggtcccctcacccccaagtctccccagagggaaccattatctggaattttatttcattcccttgtttttctttaaacttttcttccagtttaaccatatatgtctgtattctgaaatactattgttgagcctgcctgtttttgcctttataaaaatataccaaatttaagtctaaatatacatattatatatatataagtttatctagatgagtcttactacatattattttgcaacttgttttgttcccttaacattttgtttatgggttatgtatggcagtagtgtattcatcttcactgctgtagactattttctttgtgttgttgttgttgttttaatagacggagtctcactctgttgctcaggctggagtgtagtggtgcagtcatgactcactgcaacttccgcctgctgggttcaagcaattctcctgcctcagcctccagagtagctaggactacaggcatgcgccaccatccctggctaatttttgtatttttagtagagacagggtttcaccatgttggtcaggctggtctcaaactcctgacctcaggtgatccgccctcctcagcctcccaaagtgttgggattacaggcatgagccactgcgcctggtcatattttctttatgggaaaatacccatgttggtggctccttgggtgggtttcagtatattactattacaacacagcatggcttcataatttgtgaagaatttttctagaccagggttcctgattcatagggtctgcatatcttcagttttactagatgatgccaagtaattgttaccatttttgccagtgtgatggctttaaaagagtttttcatcatggagtatatgtgtatgtggctttactttatttcccaattttcattttgagaaaatttcaaaactacagatcaggtgcaggactagtacaatgaatatacccttcacttagattcactaacatttgctgcatttgcataatctatcttttcacctatgcatggtgttcatacacacgagtatattttattttcctgaaccatttgagaattaattgtagatatcattgcattttccatctgtatctaattcagcatgtatttccaaagaacgtggacattcatttatatgatcacaataccgttattgtactcaggaaagttggcatttcattatttacacaaatgttatctaatatatagcccatgttcaaatttccctagttgccccaataatgtacttgccttaaacaacttttgattttttttttttttttcgagatggagtgttactctgtcgcccaggctggagtgcagtggcgtgatgttggctcactgcaacctctgccttctgggttcaagcaattttcctgcctcagcctcgcgagtagctgggactgcaggcgcacgccaccgcccccgcctaatttttgtatttttagtagagatggggtttcaccatattggacaagctggtctcaaactcctgacctcaggcagtccacctgcctcggcctcccaaagtgctgagattacaggtgtgagccaccatgcccgaacttttttttttttttttttttttttttaagtctctcttaatctacaggctccccttccatcttttggagttgacttccttacagtttatctgttaaaacagtctggcacatttcacctatagagtttccaacggtttgggttttgctgattacacatttatgctatagtttaacgtgttctctgtactccctgcacattggcagctggatgcacgggctacttgaaccagatcctgtttgatccttttggcaatgctctagatccacgtaggcacataagtctggtttttgctttgtttttattggttttagcagctgtagatgctcaatgcctagacccattgaatctttgggggatagaaatggtgatattggccgggcgcagtggctcacacctgtaatcccaacactttgggaggccgaggagggtagatcacttgagatcaggagttcgaaacctgcctggccaacatggtgaaaccccagctctactaaaaatacaaaaaaattagccacacatggtcaggagattgagaccatcctggctaagacggtgaaaccctgtctctactaaaaatacaaaaaaattagccaggcgtggtggcaggcgcctgtagtcccagctactcaggaggctgaggcaggagaatggcgtgaacccaggaggcggagcttgcagtgagctgagatcctaccactgcactccagcctgggcgacagagtgagactccatctcaaaaaaaaaaaaaaaaaaaaaatcagccgcgcatggtggcacgtgcctgtagtcccagctactcaggagactcagtcaggagaattgcttgaagctgcaaggcagaggttgcagtgagccaagatcatgccacctcactccagcctggttgacagaacaagactctgtctcaaaaaaaaaaaaaaagaaaagaaaatggtgatattttgcttctattgtttcattttctcaaattagctgaaatattttgataaagaaccccttctcttatctactagttacccagttatagtttatataggaaaaacaagataattacttgatttttttctcttatttatccagtttcaaaataatgaattcattccctttcctcagaagatcacctgttagtttttctttaaaaataatggccaggcacggtggctcacgcctgtaatcccagcactttggcaggccgaggcgggtggatcacctgaggtcaggagttcgagaccagcctggccaacagggtgaaaccccgtctctactaaaaataaaaaattagccaggtgtggtggcacgcgcctgtagtcccagctactcaggaggctgagactggagaatcacctgaacctgggcggtagaggttgcagtgagccatgatcgcgtcactgcactccagcctgggcgacagagtgagattttgtctcaaaaaaatagggccagacgcggtggctcatgcctgtaatctcagcactttggggggctgaagtgggcggatcacgaggtcaggagatcgagaccatcctagctaacatggtgaaaccccgtctctactaaaaatacaaaaaaattgggcgtggtggcacatgcctgtagttccagctactcgggaagctgaggcaggagaatcgcttgaacccaggaggcggaggttgcagtgagccaagatcccgccgttgtactccagcctgggcaacaagagtgaaactccatctcaaaaaaataatataaataaataaatatatatatatatttatatagagatggatatatatgtgtgtgtgtgtgtatatatatatatatataattataggctgggcacaatggctcacacctgtaatcccagcactttgggaggctgagacaggaggatcacttgagtctaggagtttgaggctgcagtgagcgctgtgttcgtaccactccactccagcctgggtgacagagcgagaccctgtttcttttcttttcttttcttttttttgagatggagtctcgcactgtcgcccaggctggagtgcagtggcatgatctcggctcactgctagctctgcctcccgggttcacaccattctcctgcctcagcctcccgagtagctgggactacaggcacgcgtcaccacgcccagctaattttttgtatttttaatagagtcggggtttcaccgtgttagccaggatgatctcgatctcctgacctcgtgatccgcccgcctcggcctcccaaagtgctgggattacaggtgtgagccgctgcgcctggccaagaccctgtttcttaaaataataaataaattaaaaatcattacgggtttatagatttaaacatatttgatagttttgaatgctttgtaattcttggtcttattaaagttcaaactgtcccattttgctagtggaagttggctctgagtcctcttgacatgacccaagtagtctgtgatagttacctcactatctagcatgtgaagatgttcccagaatttcccatcgtggttttcatttacattgccctgattgagcatcttttcacaggtttattggcttcttcttgaaatgcctgttcatgtcttttggccactttttatatgggtcatttgtcccttattgatttataagggttctttatttttttcctagatattaatagttttggccagatgtttgcagatgtcttttctcaatatggcttgtcttttcagttttggtgtcttgatgatcagaagaagttcttcatgtagttgatttattgaccttttccattatggttttcactctttgactctaggagcttaataaaagcatgaaatatttattgattgtccattgctaatccgaaaccctttcagaatagtcctaacccaaggtctcagtatcagagatgaaggccagttgtgggtgtcaggaggtcagttgtgggtgtcagtcctcagggtcacagatggctcttttagagttgtcttttttttttttttttttttgagatggagtcttgctctgtagcccaggctggagtgcagtggtgcagtggtgcgatcgcgttcactgcaacctccacctcctgggttcaagcaattctcctacctcaggctcctgagtagctgggattacaggcgtgcgccaccacgcctggctaatttttgtatttttagtagagacagggtttcaccatcttggccaggctggtcctgaactcctgacctcaagtgatccacccgcctcagcctcccaaagtgctgggactacaggcgtgagccactgcacccgactagagttgtcttttttttttttttttttttgagatggagtctcgctctgtcgcccaggctggagtgtaatggtgccatcttggttcattacaacctccgccttctgggttcaagcgattcttccgcctcagcctcccaagtagctgggattacagtcattcactactatgcctggctaatttttttttttgtatttttagtagagacggggtttcgccatgttggccaggctggtctcgaactcctggcctcaggtgatccccctgcctcggcctcccaaagtgctgggattacaggcgtgagccaccgcacccagcttagagttgtcttataattagctaaacacagcagtatgtctcagtaaatatcatattttagtttttcactagcttttttttaatgcaacaaattactatcacagaattgtacaatgactgctgaaggccaacactaattatttaaaaggcaggaaattaataaagaagcataaacctgttaccaatgtgaaaactgagcagaacttctaaagctgagctgttaatagttttattcaggcccttgctggctcagcaggaaaatgaaagggaagcagcagccaccaccctgagtaaacatgccctgctttttcttcctccattagaagttcctcggctctctaaacatggcaaagtttggctgaaagtaagtcatgtagttttaaaatgttcatctttgaagtaagctaatcacagaaggacaattactgcatgattctacttgtatgaggtatttaaaatagtcaaactcatagaggcagagaatagaatggcgattgccagggattgggggagggagagatagggagttggtaatcaacaaagttttagtcaagcaaagagaataagttctacagaccccttgcacaacactgtgcctatagataacagtaccgtattgtacacttaaaaatctgccaagagggcagatgtcatgttaagtattcttaccactgtattttttttaaatgacagcttgatgggttttccataaagttatgagtttgtgctttgtaattttttgctgtctaaaattctaagaactacaggtattaggaaatgattttgaaatgattttttctttctttttaaaaacaccattatttaccaaaatgaaaagttagaaatcctgaataatgtcatctcctctttagaaaggaatgcactcttggtatcagtgggcaggatacagcgttgtccagtggactaagaggagcgggagcaccagactcctaccccacctctgcctcttactagccctgaaaccttgggaagttactccagctctgtgggaactggcatagtacctcctggagctgttttgaggattaaataaggttatctcatgtgaggaacatatgaaatggctggactctagccacatgatagtcatcaaccaccactcatgtgatactgcacattttcgcttctgcctgagaagataatgtccactgatagaaaatggaaccataccctgtagtcaggaatccttatgtcattgttttagttttccattgctgccaaaataaatgactgcaaatttacaggttgaaagtagtgcaaatgattatcttagttctgtgggtcagaagtccaattctaaatcaaggtgtcagcagggttgcgttcctttctagaggccctaggggggaatttctttcctgctcatttagattgttgacagaactcagttcctcgaggctgtaggaccaaggtctgttttgctggctgagggctgtttccagcttccttcctctattgtcgaagcctgcagcaagtcgtttgcagatcccccttctgacctcttcttctgcctccctcttagactgcaggcactcttatgcttgaatcaagcccacccagataatccaagatcatctccctattttaagggcaactgattagtaaacttaattccaatgcaaccttaatttccctttgctgtgtgaggtaacagtcacaggttccagaaatagaagacatctttgaggggccattattctgcctacctcatcaagtgaactagaattgtgttggggtctttaacaggtcatttatccttaccttttattttcttcatccaaaaaataaagtggcctgccatataggatagataatgtttattgagcacttacttgctgtgagcttggcccttggcgctaaactctttgctcaggaagagtctttgaggtgggttctattattatccccatttataagtgaggaaactgcattttggagaagttaagtaattgttgaaaataattcaactggtgagggagtcagacatttcagtaggctgctgtacctcaaaggtttggctggctggcaatcagccttcacatggcaggcatactaattagaaatcagtgtcttgattttcttaaaaagttttggttttgctagcagaaattgtcatttgtgcccaggcacggtggctcatgcttgtaatcccagcactttgtaggccgaggcaggcaaatcacctgtggtcgggagcttgagaccagcctggccaacatggtgaaaccctgtcttcactaaaaatacaataattagctgggtgtagtagtgggcgcctgtaatcccagctactcaggaggctgaggcaggagaatcgtttgaacccaggaggcagaggttacgtgagctgagattgcgccactgcactccagcctgggtgacagagggaaactccgtctcaaaaaaaaaaaaaaaaaaaaaaagaaattgtcatttgtgttcatggacgtggtaagaaaataaaaactgaaatcagatatgtatgaaaatgagttacaaaatattctagataaaactttctctgtctgaaaatgcaaaaaaaaatgatttctggcttgtgctaaatcacgaactgttttttgaagtcagaatgttgttttgtctgagatcctggagttctctgccaagagagatctgatttgtgacagggtggtggatgggctcaatatttttttaatgagatattggactgtgctgttttgttatactataagtgatatgtaaccaaacaagaaaattttcctagcaacaaagttgttttcctgaatcagaagaatgcttttgtgtgctcattttcttattgtccaaaagataaaaaagcttgtgaatttagcatcttatttttttgagattgaggtactggcgagtatagatagtagaatatataagaatatcattggaagtatttggcaagcagtatgttaattcagacctaaactgtatttaagtagagaactaacttgtttttttgtttgtttgtttttgtttgtttttgagatggagtttcactcttgttgcccaggctggagtgcaatggcgtgatcttggctcactgcaacctccgcctcctgggttcaagcgattctcctgcttcagcctcccgagcagctgggattacaggcatgcgccaccatgccctgctaattttgtatttttagtagagacggggtttctccctgttgttcaggctggtctcgaactcctgacctcaggtgatccacccaccttggcctcccaaagtgctgggattacaggcgtgagccaccacgccctgccgagaaccaccttgtttttatgccagacccgattgttggacatgattatctcactggcccttataagcctttttttctctcttcttgttcttcattagtctggtgagggacccagacatttcagtaggctgctatacctcaaaggtttggctggcaatcagccttcacatggcagtcatactaattagaaatcaatgttttgatttttttttaagttttaattttgctaacagaaattgttattcgtgttcatggatgtgttaagaaaatagaaacccaagcttttttacattcatcagatctctaagttctaccccattccatttgtttgtttgttttgagacagggtctcactctgttgcccaaactgtagtgcagttgtgcagtcacagcttactgcagcctcaacctccctggcttaagtgatcctcccacctcagcctcctgagtaggtgggaccacaggcatgtgtcatcccacctggctaatttttgtattttttttagagacaggatttcagcatgttgcccaggctgatcttgaactcctgggctcaagtgatccacccgcctcggcctcctgaagtgctgggattacaggtgtgagccactgcccctggctttccatttgtttatgcaacaaatatttgaatagtgtgtgctaggaggccctagggatattgtgccctcatgaagcttacaggttaatgaaagactcaaacatgaaagaaataattacacaatcaggaagtacatgagtgctatgaaagggaatagaaggttctgctaaattgaaggacagggtacaaagaaagccttgatgtaaaggatgaataacatttagctaggcaaaaattgggattgtctggtctcggtcagtggggtatattttgcaaaggtcttgtcccagtagggagtttgtcaatttcgagcaacagcaaaaaggcctctgggttgtaggtgggtgtgtgttcacatatgggtatgtgtgttcgcttgtgtgcatgcatgtgaggaggcagggtggggagtggctctggaggaggagaagggcacagattctcagtcctgtagcactcttgttcagagcatcaagtagacctgagaattgtatgttgatcattggtccgccaagcagttcgtatggccttgtttcccagaactccatcatcaagtggatgtggtgaccatatactttatcatcaaaaccaggatactctttttttttttttttttttttttaaacttctttttctatgttgcccaagctggtcttgaattcccaggctcaatggatcctcccgcctcggcctcccaaagtgctgggattacaggcgtgaaccaacatgcccggcaaaccaggatactcttgagagtgaaaggggacactattaattatgttgggacaacgggtataaaacagtacttatagaccagttctcagccactccagggagccccaaagttgcctagaaaccatgctctgaaatgacagggttagtcacgtgctcctgctttctcaccttttcctcttccttcatccatgaataactctgaaagaggggcaccaggagaaactgctccaagtctatacaacagaatcttagcccccatggcccgcccagctgcagcctcctgtttttcagactgccatctgatctctgactattaatgtgttttcagaattaaagtctaaaaaacgtatagaaaagaaagtaaggccttaaaagtttagcacgtgaacttttcccactagaagcttttcctacactgcttcttatggattacatggcctaattatatgttcccggagggccactgggcagaatgggtgtggtctaacttctttcagagtaaacatgttttgtggattggcccctatggtggataatggtgaataatgcatggagtaaatacctacaggaagccttcccataggtgtaaaacctttatttcaggaaataaaaggaagatatattgattttttaattagaatcaactgtttggctgaatctgcataatgaggattaatggagctttatttcctgctctctctgcccaagtcactctacagtagggccctcagagagccctagtaacttcttcaatttactgacagatggatcactttgcagtaaaataatatttaatggtcggtaactgcgagaatgtgggatctcattgtcctcctcagcctttcttcaacaaccccccaagtcctcaataaaatggtttgaccctgtcccccataataatttttaatgttcatgttcagccaaatactcaggacactaaggagttgcactatttcttttcaaactgcattcaagctctttcttttgttttaaaagccaggaaatgtgaagaattcacctggaactaagtagaaaactccatgctctgccatcttaatcaggtaaaaaacaagaaatttctgtgattattttcagcattgtagtgccagctgaaatgacttgtttttaattaatttaatttaattaattataacagtttcaatttgatgtgaaaatattttattccatcttttagtttctgggcttaaatgctgtgacttacttatttgtgtttgttccactaatgttacctgggttttttagacaagctagaaccagacagttgggatttgtctacaaatgtatttcaaacaattgaaaagtgtcattattccttaggtttttttcaaacaacactttattatagtaagtacacttgtatttatctaatactcagtgaacactggaatgcatgactgttacagagaggctcaaaacactagttatattgtttgtgtatatatgaaaaattgtataatagcacttgtgatttcctggtaattagaagactgtaattgaatttggaagcaacctagatattcaactacaggaaaatggcttaattatggtatatctataaagaagaatattattattctgtttctacagtatttaattgcatgggaacgtgtgcacaattattgttaaatgaaaaaaaggtagtgtgatatgtttatagaggggatgaagccaggagatacgacagaaagtgtgtatctttcagtggcatgatgatttttatatttttttcttctttataactttctgtatttaaaaaattttctgcaatgagtatgcattttataatcagaaaattttttgaaaattggtgttacatttattgtaaatcatggcccttacttaaaatttatgaaaaccctgagtttgaagggtcttttttcctcaagctttctttatatttttggagacccaaagagtcacataaactgagaatttgagagtggttatctggcccaacccccagcctcaagcagactcccctgaaaccctgtatgttccttcttttacaccagcactgatgggaaactcaccctatggggcagccatcctgggacaattctgagtttttggaagctgtttcctctgctaagcaaaaatatgtctccttagtggtcacagaaaacaaatccagttcctctttcacagcatagctgttcatacagtaacccaacatcagtatgttctcagatacaaactattacccggggagcttggtaaaaggcaaagggcaccccagaatcagtatctctggtgaatggggccagatatgcatgggatgtgccattagaaggatgactggagggtgagcagccacagagtgacacatgtcctctagagacttgacttttaatatggttatatttctctctttttttaaatccctgtcagccagaatggatatatttctgtacagggacaatgaaaaagacatagaataaagggaaattaggtaaatatccatttcaattttcaaagatactctgcaccagagttcagcttgctgaaatacacaaccttgacttcattctttattgtttttagatctttattggaggaggtgtagcttttaattataaaagtgattcgtgttggttgtaaaaaatgtttttagctaactgttttaaaagcttgtcttggccgggtgtggtggctcacgcctgtaatcccagcactttgggaggccaaggtgggcagatcacgaggtcgagagatcgagaccaccctggccaacatggtgaaagcccgtctctactaaaaatacaaaaaaaaaaagccaggcatggtggtagttgcctgtaatcccagctacttgggaggctgaggcaggagaatcgcttgaacccaggaggcggaggttgcagtgagccgagatcgtgccattgcactctagcctgggcaaaaagagtgaaactctgtctcaaaaacaaaacaaaaaagcttgtcttatcctttattcttttctttttctttctttcttttttttttttttttttttgagatagagtttcactcttgttgcccaggctggagtgcagtggagcaatcttgctcactgcagcctctgaggcctcccgggttcaagtcattctcctgcctcagcctcccaagtagctgggattacaggcatgcaccaccatgcccagctaattttgtattttttagtagagacagggttttagcatattggtcaggctggtctcgaactcctgacctcaggtgatccacctgcctcagcctcccaaagtactgggattacaggtgtgagccaccacatctggcccctttattcttttttccagaggtaatttttgttaatagtttggtatatcattccagacttttaaatatagatagatagatagatagatagatagatagatagatagatagataggccgggtgcagtggctcacacctgtactcctagcactttgggaggctgaggtaggtggattatatgagtctggcagttcgagaacagcctgggcaatatggcgaaaccctgtctctacaaaaaattaaaaaaattagctgagtgtgatgacgaacacctgtagtcccagttacttggaggctgaggtgggaggatctcctgagcctgggagaaagaggttgcagtgagccatgatcactccactgcactccaacctgggcaacagagtgataccctgtctcaaaaacaaatatatatatttatttatatttaaaatttatttataaattaaataaatttatttatacatttataatatattcatgcatacatgcatgtttttggttttttgacaaaatgggatcatattccacatattgttttacaagttcacagaaaactttctttttactgttatttatctggggggatgggatcttgctgtgttacccaggctggacttcaactcctgggtttaggtgatcctcccacttcacccttctgagtagctgcacagaaaacttactgaaggcatataattgtaattatattatcatacataaagaaattaggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaattttttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggggaaaaaaaaaaaaaaaagaaattaggctggggctgggcgtggtggctcacgcctgtggtcccagcactttgggaagctgaggtgggcggatcatgaggttaggagtttgagactagcctggccaatatggtgaaaccctgtctctactaaaaatacaaaaattagccagacatggtggcgtgcgcctgtagtcccagctactcgggaggccgaggcaggggaatcgcttgaacccgaaaggcggaggttgcagtgagccgagatcacgccactgcactccagcctgggtgacagagtgagactctgtctcaaaaaaaaaagaaaaaagaaaaaaaggaaattaaggccgggcatggtggctcatgcctgtagttcaaactactcaggaggctgaggcaggagaattgcttgaacccgggaggtagaggttgcagtgagccaagatcgtgccactgcacactcccagcctgggcaacagagagagactccgtctcaaagaaagaaagaaattgcactaattccttaacatcatctaatatccagttcaatgtacacattttcctggttgtttcatgaataactttttacagttggttcgtttgaaccaggatccaaacaagatctgcctgttgtgtttgactgataggtctcttagaactgtaatagtttccgctccctcattgtcccttgctatttatctgttgaaaaacctggcttatttgtcctttagaattcctgttttctacaaggattgagctgggaggggaaaaaaagaatttctcatgttctggctgtggccgaatgtatccatttagtatcattctgtttatctcttggtttctttcttctctatatttcccataaacttatagttggatccgaaggcttaattagacttaggttcattttttttttttgccatagacagtactatattaatctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgcaataaatctatcaaattcctggggaagacaaaagcagattaataaactgagatagaaaaaataagctagtagtttacatgtttaagaatttttggttgtatattaaaagatcaagtgaatagtcactggcctctaaaatatttagaaatctccaattgtgccgggcacggtggctcatacctgtaatcccagcactttgggaggctgaggcgggtgaatcacctcaggtcaggagttcgagaccagcctgcccaacatggtgaaaccacatctctactaaaaatacaaaaaattagccgggcgtggtggcgcctgcctgtaatcccagctactcaggaggctgaggcaggagaattgcttgaacccgggagatggaggttgcggtgaaccgagaggacgccactgtactccagcctgggcaacaagagtgaaactccgtctcaaaaaaaaaaaaaaatctctaattgctgagtatattcattacaaattatgaaaaaaagccaggcgtggtggctcacggctgtaatcccagcactttgggaagctgaggcaagcagatcactttaggtcaggagttcgagaccagcctggccaacatggtgaaaccctgtctctaccaaaaatataaaaaattagctgggtgtggtggcgggcacctgtaatcccagctacttgggaggctgaggcagaattgcttgaacctgggaggcagaggttacagtgagccgagatcacgccactgcactccagcttgggtgacagagcaagactccatctcaaaaaaaaaaaaaatatgaaaaaagcaatctggagaagactcagtttgtctttgacatgtctttgactatatgtgtattttattccagaaaagtatgatgggggtgatgcgaggaaaattacacatcaaactgagggtgatgtaatcatgctttccagcagatagatggaaatgtagttgtttaatcttcagatgtgatgtgtactgtgccatttaggcatttgttttttatttattcatccatctagttggttaattacactcagatacacagccaattgaggatctgaatgtagtgtatatgtaatgttgatggaacacaaaatcttttttttttttttttttttgagacagagttttgctctgttgcccaggctggagtgcagtggctcagtcttggttcactgcgtcctctgcctcccgggttcaagcaattctactgcctcagcctcccgattagctgggattacaggcgcccgccaccatgcccggctaattttttgtatttttagtaaagatgggatttcaccatgttagccaggctggtctcgaactcctgaccacagatgatccacctgcctcggcctcctaaagtgctgggattacaggcatgagccaccacactcgacctttctgattcttagtttaactgtctttaaaatgggaataattacagttttctctggctcatgtttcttatggtcatataatggtgatgtaaatattttctatggtttctctatttatttatttattttgagatggagtttcattcttgtcgcccaggctggagtgcaatggcatgatctcagctcactgcagcctctgtctcctaggttcaagtgattctcctgcctcagcctcctgcgtagctgggattacaggcacttgccaccatgcccagccaatctttttgtatttttagtagagacggggtttcaccatgttgggcaggctggtctcgaacttctgacctcaggtgatccacccgcctcggcttcccaaagtgctgggattacaggcatgggccaccgcgcctggcctggtttctctatttaaatctgaagaattttcataatgcaaaattttttctggcacagttacttatgtttttcttttctttcttttagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagt

SEQ ID NO: 4432 - DNA, 74536 bp, human
gcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtgagagcgtggagtcgagtcacagctgtcaccgccccctcccggccgcccgagccctccccgcgctctcttggggcctctctgcagccaggcctggctcaccccgaggcttttcccgccactgggccggctgcgtcccggccccgcggttcattcactggtctactggggatgagcggctgccgggcggaggcgggagacccccgggtgggtgggggcggccctttgggttgtgctttcgtgaattaaacactttgaaaatttaaagtgccttcccccaaagtacccatcccctcggctagtaccctcttgggatcgtgggtagggtgaggccagctcagggcactgtggggttcgcggctttagttgcctggcagggtcaggtttcagaacctgatgtgtggatgggggagggtcattttaggagaagctgtgcagggtatgggggaggctggggtgggatggctgggtgacgagggaagctggagctttgctccactcctcagggaacattatttaatacgggccagtggacccccttccctgcgttttgtgaactcgtgtcctttggaaaaaaatcgacttttacgatgaagacttaatttcgaaaatctgcactttagcataaagccattattctactttttaaaaagtaaattatatgtattttgtcataaaaaatcacaggctaccagaaattaatctacaaaattgagtcttcaagaagcatagtacccataaaatagtgctaatgaaatctcagaattgtactattcatttaaaagttttattgagctctgcaatgtgctttgggtacgttaataaaggctgtaaaatcagaacatgcattctgccttctagtcctggcattgccactttctagctgtgtgaccttgggcaagtcactgtgcctatcttcctttggtgaagttggggtaataacatctacctcatagggttgttataaggagtaagttggtatgtgtaaagcacttggaaaaggcctagtatttgctcttactctgttttcaggcagctcacagtttagtcaggaagacagatcctataatcaacattcatttgataaatttgtgtgttaaacacctgttatgtgctaggagctcagctccatttcagggttacaacaaggaaagatatgctgtggccagtttaactatatgtgtaccaacagtgtagtaaagtagtaaaaaggagagcaggatccacttggcttaaccaggggttcctaacctggggccctcagctcctcaaaggatctgcacatagatttcagaggatccctgaactttgatggggaaaaaacataactatttttagcaatctccaattggaattgagcacttcctttagttacgcatatgggtaatgtctcagttatctattgttgggtaacaaatcactgcaaaccagtgccttaaaacaagaattgtttctcaaaatctgggttggctgggcagttctgctggtgacttgactgaaagttggcttcactcccatgtctgggggcttggtgcccctccatgtgcctaggttggacttcctcacttggttactgacttccaagagggcaagtcccaaggcacaaacacagcatcatgtttgctgatgtcaaaacaagtcacgtagccaagtccagagttgatatggtggggaaccacacaaggtcatagatatgagttggtgcacttcgctgggggccattcattttacaagttcctactgtaacaaatcacagtagtattagcagtacctgttaccagtagaagtcacagtaccagcacaagtcacagacattttcatattacattacagttgttgcagatgtcaaaatatcacttatgctcattactacttcagaactatggtagttataagactcactgctagatctttttgtttagtgggctagtaaagaagcacatactgcttatatcagatatttgagtttaaaaaataagattatttcaatatagttgggacttttttgtatgcaattagaagcattattttgagaaggagtctataggactcactgacggccaaagaggtccacggcagaaaaaaaggtaaggaacccctggggacttcagagaaggcttcacagacgggacacttaaatttagttttgagacaggtaggagttcttcaggtaaaaggggtggggaacatcagtggtattccattgggggaagtgctggaagctcagttttgatgtgtcaagggaaagacatagtgagctgagattattattattattattattgttatcattattatttttttcagacagagtctggccctgttgtccgggctggagtgcagtggtgcgatcttggctcactgcagcctccgcctcctgggttcaagtgattctcctgcctcagcctctgagtagctaggattacaggcgcccgccaccacgcctggctaatttttttgtatttttaataaagacggagtttcaccatgtgttggccaggctggtctcgaactcctgacctcgtgattcgcccgccttggcctcccaaagtgctgggattacaggtgtgacccaccgcgcccgactgaactgagattatttcaggtgaacatgtactttgggtagaaaagatcacaacaaaccttggaggacaccaaaatgtaggagtaggcagaggaaagggggaggccagacttgagaagcagaagtaggagcagaaaagagtgatgtttagaaaatcgagggagaaaagtttcaaggagaaatggctatgttaggatgctttcagctgggaaaacccaactgcttaaatagtaaggaaaattctctcacaaagtccagaggaagaatggattccaggctctgattcagttggtcaacagtgtcaggccaggcacggtggctcacgcctgtaatcccagcacttcgggaggccgaggcgggcggatcacgaggtcaggagatcgagaccatcctggctaacatggtgaaaccctgtctctactaaaaatacaaaaaattagccgggtgtgttggcgggtgcctgtagtctcagctactcgggaggctgaggcaggagaatggcaagaacccgggaggcggaggttgcagtgagctgagatcgcaccactgaactccagcctgggagacagcgagactccgtcccaaaaaaaaaaaaaaaaaaaaaaccagtgtcatcaaggacccatctcttcttgggtttccacagtcaggttggtttcctttagggttgcaagatgactactagtaacatacacactttctcattctctagagcaagaggaggaggagagagaaaaaactcccacacttggtccttcagtctgattggaccaacttaggtcagttgtctgaccctgtaacagttgtcagaggaatgccatgatctgattggcttagactaaacaggatcaacccagggtggcgtcacttaatcacaggggagaggaatgcattcatgaacacaatggagttcttttaggaaggaagagggagaatagagactggatatgcaaccaacaatgtccatgacggagatataagctagatgagatatgagttagttacatatcatgagtcgtgttcactgatttgggcactttggaaagctttcatgatccttatactttaggtttactgatggaagtgaagggtagattaacctgggttggtgactgagggccaagtaagtggacactatgatggttgataagcttgactatcaagggaaggagagagaatttggtaactagaaggatatgttcagtcaagattctagagagaatacctcagctgtgcaagggagagatattcccacccgagagatggaaggaaaagaaaggtgcgagagattgtagaccagtggttctccatagaatggtacgactcaacagaatggtatgttttggaaacttgtggggttgttctttttttcttttttcgtttttaactttgcaaaaattataactgaaaatggggttgttctttatgtctttagttgtgttgaacatttacatactgaaatataattcacataaatctttcctttttattcacctttatgctaccatcagagtatactgatttactttttggacttatgcatgtaacttagtgatgaattttatttcaggataccagaagagtgtcagaaaatatttgtcataaaatggtgatgttaggtctagtagttgagaaccagtgcttgtcaaactttaatgggcatgtgactcttgttaaaatggattccaattcagtaggtctgggatgcggcctcaaatgctccatttttttttttttttctagatggagtctcgctctatcacgcaggcttgagtacagtggcgcagtttctgctcactgcaacctccgcctcccgggctcaagcaattcctctgcctcagcctcctgagtagctgggattgacaggtgcgcgccaccatgcccagctaattttttgtatctttagtagagacggggcttcaccatgctggccaggctggtctcaaactcctgaccttgtgatccacccgcctcagcctcccaaagtgctgggattacagacgtgagccgccgcacccggccagattctccattttttaactagttctatagttttcgttggtcccctttgactagcaagaattgaagccaatcggtagatgaatggttcttgtgttttcgagatggatggtcttatgaacatggtgggatttgggagaggcactgaccaaggaacaaaaagataggccagaccctttgagggctctgctgagagcactcctgtatgtttgtgcagagtggggatggagtaaacggtaggattgatcggggtttgggagttaacagcttgggttaactagaactggagggcaaaggagttaatagtataggtgttggtagtaaaagtacaatggtagtaaaagtgcagtgtgtctgactagttatgtgcatattaagtacacattgtacttaaaatatatactgcgatgttttgatatagttattcatcttcaggtcactagggggcattggtggattaaaaaacacatttgaaaagctgcccagtatttgcattccattgtaggaagcagcttttccttgtgctgctgcaggaagtttgaatattggatacatatacccagattcacgttattagatttccttcattacacagattttatcctagtccaactatgggctgggcatcatgctggaccctggtgggtacaagtgaaaagacccagttcttatctaggagagaggtcccaaatctggccacaaatcagaattattcaaggagacagtttccaagcccctgcgcatggttctgactgactttttagttggcgtccaggaactgctagttttgaaaaagccccccaaggtgattatgaaactttcatttcagaagctcacaatgcacttaccagcacagacattaaaggtccgttaacgatgcagtgggtctcaaccttgactgcatgttagagccacctggggagcttttaaaagtcccgatgcccagtctagaacctataccaatgacatcaagaatctctaggggtaggattaggcatctagtttttggagcaagcagccagccttgagatctactgacttagagggaagagcaacagcagggggcatcagaaggctttatagagaagaacatgcctatgctgatctttggagctaggcagacaaggttgaaagggccttccaaacagagaagaaaagcacatgcaaggacacagaagtgtgagagtgttcagaacagtgttaagaccttgggcttcactgtgttccttgtgagagatactaaagttttctgtagctgcttcctcatttgtaaaacaaggatgagatgcttaccaacctcaaattattgtgtggattaaattcattcctacgcaaagcttagaacagtgcttggcccaaagtaagggctgaagaaatgtgagctgttacttttagttggcatcttgtaagatggcatcttgtaactacctgtgttacggtggtgcacggtcttggggctctccaaaagtattttttatttcaaaacttggtagtcagttggatgtggtagatgagggagaaggataaattaaggtttctgcccaggcttttgacttttgactgtgggatctattcattgaggtgggaactattcattgaggtgggaaagtggaagaaggttgaatttggtttgagggggaggtgatggtttggttttgaacaggttgggcttgctgaaatatctgggcattggaagggggaaatcagttgatgtagaaccccagggtatggacttttcctgccacagacgtgggctggaaattgggaaatcatcagctgctaactgaagcctccagggcaagaaggtggcctagtgaaaactggtctgtgtcacttccttcctcaagggcaaataacatgacctgtactcagagctcaccacaccaaggagcctgagtgaacatgtccatgactatgaggtgttattacctcacacattctttgtggcttagtgtaatacttacattgcctgtcttcctgaaattaattttcttaccatgttactagtatgttactagaactgcgcggagaattacaatgctaaatggaaaaggaaaatcatctgtaaattggaagagtaatgtaacttttatacttgagcattattttaaaagccacatatttggaaagataatgaaggttttttttccctaacagtttaagcatcttcaagggaattcttcttgaggaattatagtaactacatttttactcacataaatacattttttatgtgcagaatcaattggttgtttctttttcctttcttacctttcgaagaagttagacagtggatcacagagacgaagaaaaaactgctctgtagctctggatgcaatcttttcagcctcaggttctagttgtgtttctggctgagcgaccttgttgagatttctttttttttttttttttttttgagccggagtcttgccctgtcacccaggctggagtgcactggcgcagtcttggctctccgcaccctccgcctcctgggttcaagccggtctcctcccttagcctcccaagtagctgggactacaggcatgcaccagcacgcctggcctagtttttgtatttttattagagatggggtttcaccatgttggccagactggtcttgagctcctgaccttaagtgatctgccctccttggcctcccaaagtgctgggattacaggcatgagtcaccatgccgggccagttgagatttcttaatctctcagcgtcctctgatcatgatcctgtggggatagtagtatgtccctctgtatctcacaggattgttgggagattcaattgagataatatgcgaaaagaaccgtgaactacaaagcactatatcaatgtaaggtgttttctgttcctcttgtatcacatttgtccactgaagtaatctatgcttgcaggttagcactctggacttaacaactgtaaaacgtgaattaacttgggttatttcacttctcatttggaaatgaattctgctcaggacactgtagcattcttctatctacttctgaaatgcagatagcctcacagttgtaactaacactggaagaggagaaagaagaagtaaaacgatacattaaaagaacggagagattagaggcacagtggaggagaaaagtagatgatgtaccagacatttatgataaatgaattgattaccccatgaggcctgttgatatttgtagacttttatgacgtaaaggtttaatttataatctatatgtatatgtgttccacacccatgtcctttctaggctagactggaacttcttagaggctaggaaacgaacttgcatatttgtttgtattgtacatttaaaattagatatataaatgcatgttattaggtgtgtaataaatctcaatagcaaagatatctgtttcaaaaagtttagacttatttttaatatgacaagaaagtactaagagatctttaaaataaaggaattgaaagagtgtatcagttgattttccccaataatgcttaagtggaattttacagttagttcatacagcatgaaactttatatattttcagggacaaaaaaatcctagtctaaagttatattttagaatttggaagttatttatttttcacttttgctgagtttttcctaatttttgcatagcctcatgccagttttgttagaaaatttaatcagtgccaatttcttaatgtggtaggtttttaaacttattttcagtgttcactaaaacttggagaagcaggaatgtagggcaagggtcgtagagttttcagtatgctgaaagcctatgactttgattgttaagctatattttcctgatacagctttatgcattatggatagtatagttgaattttaagtgaatattgttttaaaggcactttaagtgcagttatcctttgtcttcctatttctggctgtttgaagcaatgcagcgtgttttattcaaagcccacactggctcccgcttaaggacttctttgtttggttccatgaggatgaggagccccctctgtgggagctagagatagatccacaagtgcatgttcattgccttagtgtggaggaattcccagtagtttcttttttcagatattcctgaaaagaagtctattccttcttctgaacagtcttttaaaatggaatatatgaaactaactaataaaggttctttttttcttttcccccattccacaaacttcagtccttgtgaactagcctgtttttgtttgtgcttgctgaaaatgagtctcctctcctattagagatgctgattcatgtgacatgggttagactggtgagtgagtaagtaagcaaaaagtgattatacgggctccaagaagtttcctacattgtctgttgatggtttacctcacttggcagatagaactgagcctgtttgtggagtcacaccatttgggagtcctgttaaagttgctgggtatagtccaaacatttactttacttgtttttgttccttatttttgcacagattttcattatgaggtcagatggttatcaaccgaattgagtcttgtacatgattttttttttccaaaaaaggcttacagttttccttaaagaagaaaaacgcacatgaataactgagatgaagtcaaaggcagttttcattagtgagtttagagttctctgtgcacatggtggtctgttaagatatgaaacccgggtctaggcccgacgtggtggctcacacctgtaatcccagcactttgggaggctgaggcaggagaattccttgagtccaggagtttgagaccaacctgggcaacatggcgaaaccccgcccgtctctacaaaaaatgcaaaaattagccaggtatggtggtgcctgcctgtagtcccagctacttgagaggctgagatgggaggatcacttgagcccaggaggttgaggctgcattgagctgtgattgtgccactgcattccagcctgagtgacagaatgagaccctatgtcaaaaaaaacaacaacaaaaaaagagatatgaaacccatgtctaggtagattttttttttttgagacagagccatgtgtctagatagaaacctgtgtctagatagatttttttttttttttttgagacagaatcatgctctgtctcccaggctggagtgcagtggcacaatcttagctcactgcaacctccacctcccaggctcaagcgatcctcctgcctcaccctcctgggtagctgggactatgggcacgtgccaccattcccagataattttttgtattttttgtagagagggggtttcacctttagcctgttgcccaggctggtcttgaactcctgggctcaaaggatccgcccacctcggcctcccaaagtgctgggattacaggcatgagccagcatgccctgcccagatagattttactttgacagactagctctcctattaaatgatgtacattttattagttgcttggaaacacagatgcatttgaaaagctaaacttgaagtaaatgtttcccaacgattttttcctccctatatttccttaattcagaaaagattgagtgggtcccaggatgccattctaatagagaaaaaaacacatatatataggagtcttaagtagcagtaaatttctgtctggatgaggaagttcaaaataaattctggacttgataaattacatattatctgtgttccaagtctttaaaaccagtatagcccaactggatgactcaaaacctgcctaaatgaacaattatctcactctttggccctaaggttttcttcctgtttatcgcacaagtttattatttttctacatgaattttataaaatctaatcgctatctttaaagagtagaaaatgaaacaattgcagatgagacattttgtttgctttgctgacctaattttgtggtgaattctaccctccaaagatgaaacagaacttggttttctgtgagaaaaagataatattagtcttgaaaacagcctcatttttttctctgcttatctctttagattgtagtctgtttacagtggatgagaaagagctaggaaataccaattactgtagtacagaactaaagaattaaaaatttctcataaaatagttctatgtttgttgtattaggaagagtttttttaatgttgtttgaagtctaaactttactgggcatggtggttcacacctgtaatcccagcgctttgggaggccaaggcaggaggattgcttgagaccaggagtttgagaccagcctgggaaacatagtgagactccatctctaccaaaaaaaaaaaaaaaaatagctgagtgtgctccgtcacacccatagtcctaggtacttgggaggctgaagcagaaggattaggtgagcccaggagttcaaggccacagtgagctatgattgtaccactgcactccagcctgagtgacaaagggagataaattcttggctttatatcctcctttgctgtgaaacagatcgaaatgattgtgggttttattgttattgttaaagtatgagtgctcccaaattttacattcaaatgaatgcatcaaaacagtcgttttgagaggatagatttaattatactgtcattatatttattccaaaaattctatcactgatcaaaacatttttactcttcctcatttggaattatcttcaaactttgtggcaaacctttataatatcctcaggagctagccatttttgttctttgcatgttacaaaacaaatcaatggtttttttgtaaaaacttcaggaaatagagataagaattacctttaatatcaccacctatagacaaccactgttaacatcatattttttttttttgagacggagtcttactctgttgcccaggctggagtgcagtggcgccatcttcgttcaccgcaacctccatctcccgggttcaagcaattctcctgcctcagcctcctgagtagctgggattacaggcgtgcaccaccacgtccggctaatttttgtgtttttagtagagacagggtttcaccgtgttggtcatgctggtctcgaaccactgacctcgtggtctgcccacctcagcctcccaaagtgctgggattacaggcatgagccactgcgcccggccctaacatctttttagactccgttctggacatattcaaatatacccttggtatgacattttcaaaaaactcggtggaatcatactacaagtccccttcctcttttttttttttaaaaaaaatgccattttcttttcttcttcttcttttttttttagtagaatgagataatcttattattgaccaagtttacataaagcttgattctttaccgccaccaccaccacaacagaaagaaaagtttatgttggacactacgtttaattaggagatgtagaaaaggttccagtagagattgttttaatgaagactaatattgtaatttttttttctattttactctaagtcctgggatacatgtgcggaacatgaaggtttgttacataggtacacatgccatgttggtttgctgcacctatcaacctgtcatctaggttttaagccccgcatgcattaggtgtttgtcctaatggtctccctccccttgccctccatcccctgataggccccagtgtgtgatgttcccttccatgtgttatcattgttcaatcccacttatgagtgagaacatgtgatgtttggttttctattcctgtgttagtttgctgagaatgatggtttctagcttcatccatgtccctataaagaactcattctattttatggctgcatagcattccatggtgtatatgtgccacattttctttatccagtctatcactgatgggcatttgggttgcttccaagtctttgctattgtaaatagtgctgcaataaacataggcgtacagatgccattttctcatctttgtgtgtgtgtgtgtggagataatgaatctttttttttttttgaggcggagtctcactctgtcacccaggctggaatgcagtggtgcgatctcggcccactgcagccttttgcctcctgggttcgagcgattctcctgcctcagcctcctgagtagctggggctacaggtgcccaccagctaattattgtatttttagtagagacagggtttcacactatgttggccaggcttgtctcgaacccctgacctcaagtgatctgcccgcctcggcctcccaaagtgctgggattacaggctcgagccaccgaatccggcccattctctattctttaccactcttatttaaaatatatcgagactgattttctttactttttttttttaagcggagtttcactcttgttgcctaagctggagtgcagtggcatgatctcggctcactgcaacctccgcctccagggttcaagcaattctcttgcctcagcttcctgagtagctgggattacaggcgcactccaccatgcctggctaattttttctatttttagtagaaacagagtttcaccatgttagccaggctgctcttgaactcctgacctcaggtgatctaaccaacttggctttccaaagtgctggattacaggcgtgagccacggcgcctggccgagactgattttcttttaggcttaaaatgtgatctgaaggcatttagaaatggaagccatatgattacatattaaaagtaaattttggttgggtgtggtggctcatgtctgtaatcccagcactttgggaggcctgaggtcaggagtttgagaccagcctggccaacgtggcaaaaccccgtctctactaaaaatacaaaaattagccaggcgtggtggtgtgggcctgtaatcccagctacttgggaggctgaggtaggagaatcgcttaaacccgggaggcggaggttccagtgagccgagatcacaccactgcactccagcctgggtgacagggcgagactctgtctcaaaaaataataataataaaataaattttaaaaaataaatttcacttatgaaatttatataaatagttgtagtaaattccgactccatatatgatttatcaaggtaactgctttgaaaagaaaacatctatttaaaaaaaatgttgtaagtaatactgaaatacttttccttgtaaaaagtcaaaatagtacagttggtcaggttgctattgtccacctccccccagccccctttccagagaaagcctctgttctgtttggtgtgtggccctacatgttagaaaggattgctggccgggcatggtggctcatgcctataatcccagcactttggaaggccgaggcaggcagatcacctgagatcaggagttcgagaccagcctggccaacatggagaaaccccatctctactgaaaatacaaaaaaaattagctgggcgtggtggcaggcacctattattccagctactcaggaggctgaggctggagaatcacttgaacccaggagacggagattgcagtgagccgagattgtggcactgcactccagcctgggtggcaagagtgaaactctgtctcaaaaaataaaaaatataaaaataaaagattgctgtataaaatgtagatactgtcctgaatgctccttatggaggagagtattctgtattcttttgacgtttcaagaattgtggactcatttctcttgatttttatttttatttatttatttatttatttttcagacggagccttgccctgtcgcccagactggagtgcagtggcgtgatgtcggctcactgcaagctccgcctcccaggttttctcctgcctcagcctcctgagtatctgggactacaggttcccaccaccacgcctggctaatgttttgttttttttttttttgtatttttagtagagatggggtttcaccatgttagccaagatggtctcgatctcctgacctcgtgatctgcccgcttcggcctcccaaagtgctgggattacaggcgtgagccaccgcgcccggcctttctcttgatttttcattcaatttacaacacgttactgaggacaacagtgtagcctgattttgacaaaatttttttattgtcttcatcattttgttgtattctgagttctttcacatagttcttttttttgtgttggttacttagaataagaataatctcaaaagtattgtcagtgttcatagtttgttttttttttttgtaaaaaacccatttcagatttttacctcctaaataattagaatcagattaaaatagttttgtttcgagtgaaaaatgctgtcagaatggaaattattgcagaaaaggttgactgaggccaggcgcggtggctcacgcttgtaatcccagcactttttttttttttttgtgacggagtcccgctctgtcgcccaggttggagtgcagtggcgcgatcttggctcactgcaagctccacctcccaggttcacgccattctcctgcctctgcctcctgagtagctgggactacaggcgcccgccaccatgccctgctaattttttgtatttttagtagagatggggtttcactgtgtttctaggatggtctcgatttcctgacctcgtgaactgcccaccttggccaattccagcagtatgagaggccaaggcaggtggatcacctgaggtaaggagtttgagaccaccagcctagccaacatggtgaaaccctgtctctactaaaattccaaaaagtagctgggcatggtagcgggcgcctgtaatgccagctacttgggaggctgaggcaggagaatcgcttgaatccgagagacggcggaggttgcagtgagtggagatcgcgccactgcactccaggctgggcgacagtgcgagactccgtctcaaaaaaaaaaaaaataattagctgggtgtggtggtggctgcctgtaatcccagctacttgagaggctgaggcaggagaatcgtttgaaccccaggggcacggaggttgtcttgagccgagattgcgccacttcactccagcctgggtgaaagagcaaaactctgtctcaaaaaaaaaaaaatttattttcattctttatcattaaagagttgcttttatgttgtcctttgtgtggcttgtaggatcattaaataaggtagagaatctcataaaaacagttttggagaaagatagttgaaagcataatgtcatacattttaaatatataaatgtaaactatatatagaaatacataaagtattatatatacttaaactatataaactatatttttaagtatatatagtatgtataagtctataagtatatatatacatatagtttatatacatatatataaacttggtagaagggtaagatactgtaagtgtatatatacttacatagagagagtttaaattatttacatggaaaatagaaataatatattccatcactccaaaaaaaaggtcacctttggatatagcctgtttgaagtagcagttgaaaagcctggtaacatgtccctcagggagttagaaacacaggaaacacacaagcctgaggcttagggagaggcccaggctagggatactgatttgagcatcagtagcatatgagtgggagttaaagacttagattttggccaggtgtggtggctcacgcctataatcccagcactttgggaggctgaggcaggtggatcccttgagcccaggagtttgagaccagcctggccaacatggcgaaaccctgtctctactaaaaacacaaaaattagctgagcgtggtggcgggcgcctgtaatcccagctacttgggaggctaaagcatgagaatcccttgaacccgggaggcggagattgtagtgagccgagatcaggccactggactccagtctgggtgacagagcgagactctgtctgaaagaaaaaaaaaagaaagaattagattttaatgaaattgccctggagtgagaagaggagagagttaaagactactccatgactcatcaaccttgaagagctatgcagaggaagagaaggcccaaaaggggaggagagagtacctagaaagcctctagaatggggatagggtagaatcctgtaagccaaagaaaggggttgaagatgtagagtagtcaccagtttcagggtgcaaccaagatgccagatgtccagtggggtttagcaactgggaggctattggtggtcttgggaagaaaggttttaggtgcatttagtagtaaagggaggaggagataaaattgagaaagcaaacagaatctgcctttttgactttgtgcttaaatgcggatgctcctcagcttgtggtggggttgcattctgataaacctatcataagttgaaaatatcattaagtcaaaaattaacacacctaacctaccaaacatcataatttagcctaccctcccttaaatgtactcagaacacttccagtagcccacagttgggcagaatcatctaacacaaagcctattttataataaactattgaatgtttcatgtacattattgaatactgcactgaaagtgaaaagcagaatggttatatgggtactcaaagtgcggtttctacagaatgcgtatcgcttctgcaccatgtaaggttgaaccatttgtaagtctgagaccatttgtataacatacatataggaaagtaaacggggcataagtgaatttttacaaactaaacatactagcactctagaagctcttctcgtggcccttctagtcactacccagcttgctaagggtatccactattctgccttctaaccatagtctacttttaaaataaatttgtcaatggaagttggtagaagggtaaggtagttgttagagagggaattaggggtggagggtatttgttgtgttttgtttaagacgggagagattttcttgaatgtaaataaatgtcataatttctctagtgggtggccagtcactctgtttctttttatatttaggacagttttcattttatactttcaaatgtttttaaaagtatgtttgagtgcttatacaaacttaagttgaataactgttctctaagcatatgtttgtggaatggtggttttcaaaactttgcttatcttgggaatagattcttgggcccctcttagattcagagtcagacactctgggggaagctgttagaatctatgcttttaaaaaattccccaggtgggccaggcgcggtggctgacgcctgtaatcccagcactttgggaggccgaggtgggcggatcacgaggtcagaagattgagaccatcctggctaacacagtgaaaccccgtctctactaaaaatacaaaaaattagccaggcgtggtggctggtgcctgtagtcccagctaccaggaggctgaggcaggagaatggcatgaacccaggaggcggagcttgcagtgagccaagatcgcaccactgcactccagcctgggcgacagagcgaggctctgtcttaaaaaaaaaaaaaaaaaaaaaaaacaactccccaggtgattctgaaacctcttgtgtacacaggcctgcaaaagccttctatcatgaagctggcatatattataaatggaagtctaataagataatagttctgtaattgtgggagaaaagagtcaccctttttttaaatgggagagagtattcactagattctctataaagttgaaaaagaaagcaagttgttaggtatttgagccccaccattcatgagagtctgaataattctgagggtgacttatttagcttaaggtttttatttgtctttaaggcagttttactggaacataatcacaacatgatcccagagctatggaattctgggcagtcagtgtacttttatttgcaaagcaagaacagtttagccttctggacacccattatgatttgtttgtttacgaccttaccagattcatgtcttggtaaactgtgtctaagaatctacctttaaagctgagggagctgactgataaactcaatctttttattttattttattttttgaggcagagtcttgctcagtcactcaggctggaatgcagtgacgcgattatagctcactgcatccttgacctcctgggctcaagtaatcctcccacctcagcctcccaagtagctgagaccataggcatgccccaaacacctggctaatttttttttttttttttgtagagatggagtcttgttatgttgcccaggctggtcttaaacttctggcctcaagtgatcctcccacttcagcctcctaataaactcaatcttatgcctgaatcttttttttttttttttttttttgagatgaaatctcactctgttgcccaagctggagtgcagaggtataattttggctcactgcaacctccaccttccaggttcaaacgattctcttgcctcagcctcccgagtagctgggactacaggcacatgccaccatgcctggctaatttttgtattttagtagagatggagtttcagtgtgttggccaggctggtcttgaactcctgaccttgtgatccacctgcctcggcctcccaaagtggtgggattataggcgtgagccactgtgctgggccctgaatctttttttgaatgttaatttattttttaaattgtggcctgagtctttgattaaattcataagcttcctggaagctctataagagcagggaccttgtctgcttatgtgttttatctgtttagtaccatgtctgacatgatgtgggtgtgcagtaaatatttgtttttgaaataaaaccctggttgacctcttctaattgttatatataaccttgcttgcctgaccagatttgttttgccaacatcagtccttcgcaagcttcagtggagacagagtaagaaccaaatgtctttaagatgatgacagcctacccctttacacttcttgttagggcctcatctaacccaacaccaatactggttgctctgtttccattgacaagccccttgcgggctgtgcgaaacaaaagttttgagacatagagagtctaaggtccaagatagagtgtaccttgatactttgctggggagtaggatcagaccagaaagaaagaagagttagccacaagagtgagaaaactcaatgacactccctctgaggtttgcaaagctaagggccaccagtttacctttaagccaaattttcgttttctctgtgactatgggtcttacagctgtattcaaaacctcagagaagccaacacattagagtccttactttgagacccccaactagctgaatgccaagaaaggcatttagtaactgaagggtatactcccgaggggctggatctaaagaaatgccacctttgatctagcctgtaacttagcactaattggagattcagctcttaacagagcttgcttgactttgattgagcaagcctaactcatataatgcaaagtagaccatatctaatcagttcttggcaggtgcatatgtactcattttctgagccaactcatctgccctgaccagggagtgtacctggcaacaaggcttctcaaggactatcacttgggaaagggagtgctcagggcgtgggtacatgcagtctagagattacagccctgcatcagaaaaagtttgggggaggccgggcacagtggctcatgcctgtaatcccagcactttaggaggccgaggcggacggatcacaaggtgaagagatcaagaccatcctggccaacatggtgaaaccccgtctctgctaaaaatacaaaaattagccgcatgtggtggcgcacacctgtagtcccagctacttgggaggctgaggcaggagaatggcttgaacccaggaggcggaggttgcagtgagccaagatcatgccactgcactccagcctggcgacagagggagactctgtcgcaaaaaaaaaaaaaaaaaaaaaaagggaaaaagaaaaagtatgggggagatttcacttcttgggaggtatattcagtccgattatatcataatgggtcaggactcctcatggagagagaatacctttgtgttcatgtctcacaaagcaacccatccagagtgcgaacaggaggaaagttgataaggctagagatttttttttattatgtcccagaccctgaaagttgattgtgtttcttcaaagaactggattgttcttccttggggagacaaaagattgaagaaggttcatctcctctttgtgcccttacactgtcctggggtgattctacccatcttagcctttcccttcttaaatcctgattttgaataggttggcctgaatactcaatatgagccctaacaaattatgataaccacctggcaggcacacagtgtcgaagatggccatttgtgatgacatctggtctggccagcttcctttttactgttaagagggaaaggtggtgagcatgctgaggcagggtggggtcatctcgcaccaggaggagccccctttgaagctaaaaaggaagatgaatcagccaagatgttgagtgcatcagcttcagccatgtctacctggggaccttttaccaaggctcctcccatgggtttccatcacacagatctataccagttccttaccatggtcaggtgtgtggctggctccttaggaatgagcttggcatggattaggtgtgctagagctgatggattttttaaaaagtctaatttacatagagtgaaatacatagatttttaagttgtacagtcttagttgtacaatttgagctttgacaaatgtatataccttgaataacccataccccaatcaagattgtttcaccccagaaagttcacttgtgccacttctcagtaagtccacttccttccaactcccacctccccggcctagtagtgattgttctggtttctcactatgtttgaggccatgggttttaaaacatacagattttcttcaagtctagatggtgagagatgtcagaaagtaatacttactcaagtaaatcagaggttctcagtgggagagttgctccccaggagacatttggcagtgtctggagatgtttttgactgtcgtgactgggaggaggtgctactggcatctagtgggtagaggctagggatgctgccaaacttcctgcagtgcacaggacagccccacaaagaaggacccaacccaaatgtcagtagtgctgagtttgagaaatcctcgagtaaatcatgtgttctctgcaaactaagaattatggtcctggggagtgttcatttgtaggtctcccaggtctcctggggtgaggtttgctttttctttgttttgtttgcttgtctgttgagagcctgctggaagctgaaaaggccgctgcaggagccagctttctttggtgctaccacccttgtggccacagttcttgctgtggaatgggtatcagggtaggcttagggaggaaaactaataggagaagaggaagaagaagaaaacagtttaggcagtaaagggaggcaggcctagaataatattaaaactagaaaaacaagtaagataagaggggaaggtaaagtagaaattaataattaagaatccaataaaatgttaaaggaaatgagttgagatttaaaatcaaagataggctgagtgtgttggctcacacctgtaatcccagcactttgggaggccaaggcgggaggattgcttgagctcaggagttcgagaccagcttgagtaacatgatgagaccctgtctctgctatatatatatagttatgtatagatatagttatatatttatatatatatataatatatatatttgccgaggctggagtgcagtggcacgatctcggctcactgcaacccctgcctcccagtttcaagcaattctcctgcctcagcctcccgagtagctgggattacaggcgtctgccaccacgcctggctaatttttgtgttttttgtagagactggatttcatcatgttggccaggctggtgtcgaactcccgacctcaggtgatccacccacctcggcctcccaaagtgctgggattacagacgtgagccaccgcacccggccttactgtgctttatgagaaataaatacacccctgaagtgctgaggaagtccagacccaaaaaacatgttcttatggacttaaaatttcaggtcaactttttcttaatttccaaaagacaacagtttctaagtttgcctactttagcttttcaagtaaaataaaagatacatagatagatgactagacctctagctgtctgtcggtctctggaacatgtccaaaaccaactcatcatttttccctcagacttgcccctctttttctacttcctctctcaggaatgctgtgtcaccacccaactagaaaaacccatcggaaaccccaaggtcacttaaaatctactcttttcctgattttcgaaaatccaatacattgttgttaactctagtcattatgttgtacaacagatctcttgaactactcctcctaactgaaactttgtacttttgaccaatatctccccaactccccccagcccttgccctggtagccaccattgtgctctctacttccattagttcaacctttttagattccacaaaaattaatttgtgaggtagtgcatatgttaattagctcaatttagccattccacaatgtacacatatttcaaaacagcatgttgtacacaataaatatacacgattcttgtcagtttaaaaattaaaataaatgaaaataaaaattaaaccaaggtcatcgtcactcttcctttccctttggtcactaagtcctgctaattttgcctattaaactatctcaattctactttctcctctttctcctctcctgtgcaatctttccttgggcccttatttctttccttcattgttttagcagcaccataactggtcagctggccctttaatgacttaaagcgccacactgagaaataatcgtctttctaaatggcaaactcgattctatattccatccttatttgagatcttttggtatttattacctaggacttttatgtgagccacacgagtcccattatgatctggctacaaccaacttctctgactcatctctctgtcactctgctccctcccacaaaactcgaactccctacacttctcccatgctgtttcccagcttcgtggcttcacacatgctgattcctctgtctataatgtcctatacttgttttgtctttctgtagaactgcctaagagccgggagaattcatgcttttgaaacaaggggaatttcccttgtccctcttacagggcatgtgatgggagtgtggcccacttcttaggtgccccactgctcaaaacccctagggaaagcaggcagatgggcaggtcgtggggagtgtgggctccaaccccatggcagcgtctaggggtggatgtttacagcttctgcagccccagtgggcgtgtgttacgtgtgctcttttagttttgctgtcagtaggcagcttgtgttcatcagctcagttagaccctctgccttattgcaaggacagagggctttctgtatcctagggttcttgcctgagtataccagaaaaaccggatcacacgtgggcttggaggatgagtgcaaggttttattgaatggtggaagtagcactcagcagatggaaacggagccagaaggggtatggagtgggaaggtggttttcccctggagtcaggccgcttagcagccaggctctcctctgaccgccctcagccaaactccgcgttgtcctgccgttctgctgttggtggcctgccggagtctgtcactgtgttcttctgctggtatgttgttccttgcctctgcttctcttgacgtccagccgcttgtgtgcctgcccgctagggtctcggggtttttataggcacaagatgggagtgtggtgggccagggtggtcttgggaaatacgatatttgggcacaaaaacagaaatgcctgtcctcacctaggttggtgggcacaggcccaggggtggagccctagccagggaccacgcccttctctacccagcatttccctgcctgcccctcccgtatcacttttcttttatttatttactttttgagacagggtctcgctctgttgcccaggctggagtgcagtggcagtatcttggctcactgcaatctccacctcctgggttcaagcgattcttgtgcctcagcctcccttattttattttttaatctgtcccaggccaagtgcagtggttcacacctataatcccagcactttgggaggccgcggtgggtggatcgtttgaatccaggagtttgagaccagcctgggcaacatggcaaaaccctgtctctacaaaaattacaaaaatgagctggacatggtggtgcatgcctgtagtcccagctatttgggagacaagacaggaggagtgcttgaacctgggatgggaaggttgcagtgcagcagaaatcctgctgctgcactccaacctaggcaacagtgtgagaccctgtgtaaaaaaaaaaaaaaaagtttgtccatttatttacatctatcaagttcttcctaccagaatggaagccctttcagggtgaggatatgtcttactccatattcctatttctatggctgtgcctaacacacaaggcatgctcaataattgtttatttcctgctcaaatgagacaaaaggaaatggatggaggagaggtggaaaataaatgagtgattgatttctctctaactatttaggcatgatttagcatcttggaaatcatattactgagatttgcagtgcctgtaatgtgaaagatgaggctattctgtaatacaaaacgtaatgccagctaaaatataacaaaaatatctgttgaaacgtatggctgcaaattcccatatttcagaagcaaataaagagctgaaagccattaagaaaaaaaagggtggttgttactttaactggtttaaaaacaattgatacatcttgaagtattaagtgtgcatcttgaggtcttaatttcaatgcagttttgctacagatttcttttgcttccacgatacagattagccagctagtgctgacattagttcatgtggtttgtgcccatcacaattattaggcagaaccagcagcaccaggatacaacctaaggagatcaacgtccctcctagaaaactgccacggccttcgcaggaggggtctgaatttttttttttttttttttttttttttttgaggtggagtctcgcactgtcacccaggctggagtgcggtggcacaatcttggttcactgcaacctccacctcccaggtgcaggtgattctcctgcttcagccttctgtgtagctgggattacaggtgcccgccaccacgcccagctaattttttttttttttttgtaattttagtagagacgggatttcactatgttggccaggctggtctcgaatgcctgacctggtgatccacccacccgcctctgccttccaaagtgctgggattacaggcgtgagccactgcgtccagcacattttttatattcacaattaaattaataaaccataactctcctcctctcagcccatctttttttttttttttttttttttttttttttagtggagcgattattttgtgtgtgtgaaacagagtctcactctattgcccaggctggagtgtagtggcatgatcatggctcactgaagcctcaaactcaagagttctcccacctcagtctcctgagtagctgggactacaggcacacaccaccatgcctggctgattttttaaaaaaatatattttgtaggccaggtgcactggctcacacctgtaatctcagcactttgggaggccgaggcgggcgaattacctgaagtcgggagttcgagaccagcctggccaacatggcaaatccccatctctactaaaaatacaaaaattagccgggtgtggtggcagacgcctgtaatcccagctacttgggaggctgaggtagaagaatcgcttgaacctgggcgttggaggttgcagtgagctgagatcacgccactacaccgcagcctgggtaacagagcaagactccatcttgaaaacataaaaataaataaaaataaaataaagcacagtaagcctttcagggtggggagtggctgaggttatgaatatgctcatgttctgcacattcggtctgtaacatagagaggtttaagattgcttctgcatttcaggtaattcagaggtccgtggggccagccagcctgagcttgctcaccttcaaagtctatgcagcaccaaaaaaggactcacctcccaaaaattccgtgaaggttgatgaggtaacatgttgttcatgttgcgatatattttgagtgtctgatttagttactgtaggataattttttacaaattgtatatcaggaagatgtgactgtttaaaatacatttatttatttatttatttatttatttatttatttattttgagacggagtttcgctcttgttgcccaggctggagtgcaatggtgcgatctcggctcattgcaacctcctcctcctggttcaagccattctcctgcctcagcctcccaagtagctgggattataggcatgtgccaccacgcctggctaattttgtatttttagtagagacaaggtttcaccatgttggccaggctagtctcgaactcccgacctcaggtgatccacctgcctcggcctcccaaagtgctgggattacaagcgtgagccaccacgcccagccagaagacatttaaacagagaaaatatatttccttatagtttgtttaatttgtgggaaatattaaactatggctttttcaacagataaactttaatgatacttaggtaagggcacaattaaggaatactttataaatgtttactggggaatccactgtgtcccaacaggttataagcacaactcacttttctaagtggtctgcctgattcttggcttatcttgattcttatcgagccaagaatatattcacattttttcctctctaagaaattagagatctggatcctttctgtttcttggctagaggagccgctcataagtatgtacttaataaatactaaatttaaaaaaaaaaaaaacaagaaatcttctctctactgtttacattcctttttggtctgtacttcccactaattattttggatattcagtttctgttgcctttgaataaagtgaggtaaggatctaccttcagtcctgggtagggttactagattggtgtttacataaagctaattagcttatcttttgccctttactcgcttctcaggccttggcacagtggcatttttgagggtaaagaaggcagccagcagtggctgtaagaagttctctgggtggagaataaacctgctgtcctgctttgattaacatcagaccaatcatttgaactgaatgacatgccctttggttactctcaagcttttttaaccccttcacccaccctttagagtaataaaatcttttttccaagctcaatctaaggtggaataccaaataccagtatataaaatggataaagaggagctgctttgtttgtagtcagtgggtggggagaaagtaggacacctcatagccctgcccttttggccttggcctcgttgattatggaaataaggtgcagagatagtttgagataaagttcaggttgcttgtaacccttagagtcactggaattcatgaagtattattattattatttttgagatggagtctcactcttgcctaggcttgagtgcactggcacaatcttggcttactgctacctccacctcccaggttcaagagattctcccgcctcagcctcccaagtagctgggattacaggcgcctaccgcgacacctggctaagttttgtatttttagtagagactgggtttcgccatgttggctaggctggtctcgaactcctgaccttaagtgatccgcctgccctggcttctcaaagtgctgggattacaagcgtgaaccaccacacccgaccacagagtcactgtaattcatgaattactagaaatattatattaaatacttacaaatttgataaatgtatcctgtagacagtacatcttttaaatctttgttttgttttaatgtgcgcagctttcactctactcagttcctgagggtcaatcgaagtatgtggaggaggcaaggagccagcttgaagaaagcatctcacagctccgacactattgcgagccatacacaacctggtgtcaggtacaactgttctgaaaatggagtgaacgcatttctgtttagagtccatagaggaaagtctgtattggctgcatgtttttggaaaaaggcatgataaagggccctgagatggttgacagaggctgggaagggtagtgggggtctgggggaaaggtggggatggctaatgggtgcaaaaaaaaaaaatagcaagtagcaagaatgaataaaacctatttgatagcacaacaggatgactgtagtcaacaataatttaattgtacattttaaaataacttaaagagtgtaattggattgtttttaacactaaggataaatgcttgagcggatagattccgcattctccatattgtgcttatttcacattgcatgcctgtgtcaacacatctcatgtgccccataaatgtatatacctactacgtacccacaaaaaatgttgaaatacaaggccccaagttaaaagtgcctgacttacagatgttcttcagtgccatctgaggaggggttgcagagatgccctagcttcctggtgacagctgttgccacagctacagagagaatttccctctccctgggcagtgcgtaacgccttaactagagagcagaggggctaggaactaccttgttgcttgcagttatgaaaacattgttgtctaccaggggaggcttgtgggctggaactctaaacaaaggaaaaagatgcaacgtaaacacttacataaaaattgcgaagtttttctccccccactatacaaatcagtgccacttaaaccaggaggggatatggcattttgaatgctatactaaaatagggtagaattccatactggattactgaactatttgttctagtgaccaaagaactacatatacagattggtttctgtccctgcctgggttttaggtcaggcatttgtcattacgtaaatgaaaagtatttctgtgatttttaacatcagtaaccaacgtttacaatctatagaatgcttttgtaggctttgatacatatgtttgttgtacttgatcttgattttgaaaattgaaattaataaaaactaatagatgtagatatgtgggaaattgtctagatttaccttgcttgagatttataaatttagtctttttgtttttttttttttttgagagggagtcttgctctgtcgcccaggctggagtgcagtagcgtgctctcagctcactgcaacctccacctcccgggttcaagcagttctcccgcctcagcctcccaagtagctgggattacaggcacgagctaccatgcctggctcatttttgtatttatcgtagaggcagagtttcgccatgttggccaggctgatgtcgaactcctgacctcaagtgatctgtccaccttggcctcccaaagtgctgggattacaggcgtgagccaccatgcctggcctaaattcaattttgatccagagcttgtttaaaaatttttaatttccgttgcctatgctgctgttgaacttttgttcaccaatttagaaagaaaatagtaaagcatggactctatcaacaataagaattaggccattatacttaagtatcataaccatattattgagttaagtaatacctaaagactttaaacataacatgttgtaaaatgattagactttattctcttgttctagaagatttttaaacttctggtagttaagataaagtcagcaaatttgtgtgtatatttttgtatcatgtaggcatgactactgttacttgtagtctgtctgttttttttgtttgtttgtttggtttttttggcaataaaagtactttgtaccttttagcctaaggttgctttttgttttttaccttttcttccatgcgtgatactcagtgcagcaaaatacctctctggatgatggattagttatctatatgtttatttccactactactaaatataaaaacttgcttgtaattataatagtttttgtaattataatggttttgttttcctgggtagaacaaagcctttatgagtagaaatatttctaattcctggttcctttttcagaccagcaatttctagcccttttcttgaagaaccaatttaattttgtttttttgttctttgtttttctttttttgagacggagtctcgctctgttgccaggctggagtgcagtggtgcagtctcagctcactgcaacctccgcctcccgggttcaggtgattctcctgcctcagcttcctgagtggctgggactacaggcgtgtgctaccaagcccagataatttttgtatttttagtagagacggggtttcaccatgttggccaggatggtcttgatctcttgaccttgtgatccgtccacctcggcctcccaaggtgctgggattacaggcatgacccactgtgcccggccttaattttttttaatagtaaaaatattaagctagcaaaagaagtcggcaatcattctagatattgatctgaagttttttcttttttttttttttttttggtagagacaaggtttcaccatgttgcccgggctgatctcgaactcctgggctcaagagatctgcccacctcagcctcccaagtagctcggacatcatacacataccaccatgcccaactaatatttttatttttatttttattttttttatttttttgagacggagtctcgctctgtcccccaggctggagtgcagtggcgcgatctcggctcaccgcaagcaccgcctctgggttcacgccattctcctgcctcagcctcccgagtagctgagactacaggtgcctgccaccacgcccggctaatttttttgtatttctagtagagaccaggtttcactgtgttagccaggatggtctcgatctcctgacttcgtgatccacctgccttggcctcccaaagtgctgggattacagccgtgagccaccgtgcccagcctaatatttttatttttttgtagagatggggtctctgctgtgttgcccaagctggttctcaaattcctgacctcacgagatactcctgtcttagcctcccaaagtgttgggattacaggcgtgaaataatggattttaatgaagcgatactcagttctttagatcttctggctaattcggcatttattatttcaggtcatttaaaagaatgaggatagcttgttctgacttgaactgaattacacaaaacaaatccttttccaggccgggcgcagtagctcacgcctgtaatcccagcagtttgggaggccaaggcaggtggatcacctgaggtcaggagtttgagaccagcctggccaacatagcgaaaccctgtccctaccaaaaatacaaaaattagttgggcgtggtggcgggcacctgtaatcccagctactcgggaggctgaggcaggagtaatcacttgaatccaggaggcggaggttgcagtgagccgaggtcgcgccactgcactccagcctgggcgacaaaagcgaaactctatctcaaaaaaaaaaaaattaattaataaaaataaaaataaaaaaaaaatcctttcccaaatggcaactagttttgataccttctgatacccatgtatctcttcttgtcttcactgtagacttcttgaaggtgggtaccttctagcgggtccctcgtttcctttaggatcatgtgatattcatgtacaaagccttttttttttttgagacacgcccaggctggagtgcagtggcgccatctcggctcactgcaacctccgcctcctggattgaagtgattctcctgcctcagcctcccgagtagctgggactacaggcgcgtgccaccacgcccggctaatttttgtatttttagtagagacagggtttcaccatgttggtcaggctggtctccaactcctgacctcaggtgatctgccccactcggcctcccaaagtgctgggattacaggagtgagccatcatgcctggccacaaagcctttttattgtttttaagagaatgttgacacctcatttgctttgggctatagcctttgtctcattaaagctggtcattcttgcttcaaatgggcagtttccagatgtaggctctaattaatggcagatcaggaagtagttaatatgaaagacaggtttaatctcatggagaaaagcttgccacttaaatatcaaggggattgatttttagtctattttttccattttaatggaagagtgaaatggctggattgttgaaaccactctgtttggaatctgcttcctgtggcagtagtaagccattctgctgagtaatttgcagtgaagggaagattataataggaaaaacaaacaaaaagacccagacagacagtgtatccctttgttcaaaaagcgttaataacatgataatttattcagtaaaaacaagtatatttattctgttaactttctaatcagcagatcctgtgaatagtttcattcagtttctttttacctttttaggaaacgtactcccaaactaagcccaagatgcaaagtttggttcaatgggggttaggtaagttgattttaaattaggcataatcagctacttcattaacattgaactctttaatcggagttccatgaatgagctccaagaaatctgtgtattccttaaaattatatgcagaattttagagctatgtggatttttctgggaagaggagctgttgttttcatcagatttcaggcaactagtgtccccaaatagtcaggtaagtctcttcaagatcgttaggattcttgggctagcaagtacagatacactgctttaaaaaaaagaaatctcatttctaggtgcagcgtaatacaccatactaattcatcaatagattttctgaatcggaatagctcatttgcattgcaattaatagatgctctagaagttttgaagcaggaaggagctgagttggtactcctataaaaggtcttactgcataattgatagtgttcttacttttttttcatttggttttattttccttgattatttttcagttgtgggccacttatcacatacactcacaaactggattcacagtccatgttctgactaatcttaatcagaaactggtaaattaataaagataccgatcatatttcattccccttattaggcatctcgcaaacaaaatcttgtttttacaagggtttgtttccatgatagaacaaaataaacataagtacagtttctttggtaagatcaccatggtgtattgatgtcctgatatttctgagactgtcagataaatttatcgtttgaagacaaacataacaatagctgcctactggttttttgtttttttttttttgagacaaaatatcactctgtcacccaggctagagtgcagtggcatagtctcagctcactgatacctttgtctctcaggttcaagcgattctcccaccttagcttcccgagtagctaggattacaagcgtgtgccaccacatccacctagtttttgtatttttagtagagacagggtttcaccttgttagccgggctggtctcaaactcctgacctcaagtgatctgcccgcctcggcccaaaatattgggattacaggcgtgagccaccgtacctggccccctactggttctttaaattattaaggcatgttaataagtaacatcttaattttattaatttcataaacacttatttaagacttatatgtcaggtactattctaagtgctttacaaataccaatttattgggggtggagtgaggatggttaatgagtacaaaaatatagttagaatgaataagacctagtatttgatagcacagtagggtgactgcagtcaataatactttattatacattttattttttattattttatttattttttatttttttgagacagattctcactctgttgcccaggctggagtgcagtggtgctatcttggctcactgcaacctctgcctcccaggttcaagcaattctcctgtctcagcctcccgagtagctaggactgcaggcacacgccaccacacccagcctattttttgtatttttagtagagacgggtttcaccatattggtcaggctggtgtagaactcctgacctcaggcgatccacccacctcagccccccaaagtgctgggattacaggtgtgagccaccgcgcctagcttattgtacattttaaataactaaaaaagctatactcttttaggtattgtaaataaactgaaagagtataattgggatgcttgtaacacaaagaaaaatgataaatgcttgaggtaaaggatacttcatttaccctgatgtgattattatgcattgtatgcctgaaccaaaatacctcatttaccccgtaaatatatacacctactatgtacccacaaaaattttatatatatatatatatatatataaattctcataacaagctgacagataccttattatcttcatttttatccgaggaaactagagaactcctgatatagtcttttatctgtccatgtgtggctgagaggtctcttgtttaaatttttctgagacaggatctttctctgtcatccaggctggaatccagtggcgtgatcatagctcactgcagcctcaacctcctgggctcaagcaatccttccagctcagcctcccgagtagctaggattacaggcatgtgccatcacattttttccactttttgtagaggcagggtctcacttttttgcccagactccgtacagtcttaaaacatatcttctttcccctttctttgtgatttacccactttggcccagctcaccagagccatctgggtgtccctctgtcaactgctctgtgtacacatctagaattgagcaacactgggctagtaggcaaaaataaagggaagtaaaaaattgcctcaaatgacccagactagaggatggaaagtaaaaactaggctaaaggcaaaataagtaacaggccagacagtaattaatgcaaacataatacaagtcctatagtagtatttaaaatgatcacatttcccaaagaacccaggaaaaggaaaactggcgtgtatctggtattacttaggggacagaattgctgagttttccagtttattagttcagttctgtatatattttttaagtcaccattctgccaggcctcgaaaattgagattggttaagacagtggtcacaaccactgagatgcgtgtaatatattattcagtactagtgcaaatacagagataatcacagaccattattgaaggtacagaggaaggagattagtttaattgaaatcgaggaggtgggagcagtcagggaaggacttctgaagtgaatcttgaaggagcagtgttagccactccaaaatgtgggggtgggactgctggaagcaggcattgcacactgggcccagcatgatcaggcttagaggtgtgacttggtattggatgtttgaggaaccctaagtagatagggagtgctgaagatgagattgagaaggagacatgagggctttgtgtaagtcatgacctagctaaaattcatttgttaattcatccagtatttttttttttttttttttgagacggagtcttgctctgtcgcacaggctggagtgcagtggcgcggtctcggctcactacaagctccgcctcctgggtttacgccattctcctgcctcagcctcccgagtagctgggactacaggcgcctgccaccacacctggctaattttttttttttttttggtatttttagtagagttggggtttcaccatgttagccaggatggaatacatccagtatttatcaactcctggcagtgtgatttttgtttttttgtttttttgttttttgagacagagtctcgctctgttgcccaggctggagtgcaatggtgtgatctcggctcactgcaacctctgcctcccaggttcaagcgattctcctgcctcagcctcctgagtagctgggattacaggcacacgccaccacgcctggctaatttttgtatttttagtagagacggggtttcaccatgttggtcaagctggtctcgaattcctgaccttgtgatctgcctgcatcggcctcccaaagtgctgggattacaggcgtgaaccactgcgcctggcctgtttttgtttttgtttggagacagggtctcattcagtcacctaggctggagtgtagtggcatgatcatagctcattgcagtcttgacttcctggactcaagcaatcctcccacctcagcctcccaagtagctgggaccacagacatgcatcaccacacctggctaatttttttttttaattttttgtagagacagggtttcgccatgttgcccaggctgttcttgaactcctggactcaagcaatcctcccaccttggcctcccaaagtgctgggattacaggcgtgaaccactacacccagccatcattcttaataaatatctattgaatgaacatccattattaccactgagggaagataacacagaagtgtaagcaatctatcattaaggagcttacattctccttggggagacaccagatatacacctgaataattaaacacagggtactataggattaggtaccaagtgatggtacagagaataaatatgatgggactttagaggagggagagaggtgtgaactgatgagcttaggaaaggcttttgtgtggaagtaggactcaacttggcttttatgaggtgggattggctcagtggagaggagacgaggcattatgtgaatgaagtcagaaggcatgttcagtcatgatgaataggtcacatgttgtatttatttttattctatcaccatcaacagcgatcaacagtggctattttctgagtgaaattacaagtttcctttattatccaaatttattctgttcttctgttcgagtaatgagttcagatggcaaaggatgcttatttttctgagtctaatgtatttgatttctttcttttttttttttttgagaaggagtctcgctctgtcacccatgctggagtgcagtggcgcgatcttggctcactgcaacctccacctctcgggttcaaatgattctcctgcctcagcctcctgagtagctgggattacaggagcgtgccaccacgcccagctaatttttttgtatttttagtagagatggggttttaccatgttggtcaggctggtctcgaactcctgacctcgtgatccgccctcctcggcctcccaaagtgctgggattacaggagtgagccaccgcacctggccttcctttttttttttttttttttttttttctttttaagaggctgtgtcttgctctgtggctcaggctgtcaggctgtcaggctggagtgcagtggctcaatcctagctcaccgcagccttgaactcctgggctcaaatgattcttctgccttagccttggaaagtgctgagtttataggaatgagccaccactcacagcttgtttttggttcctgagtttcagagagcaagcagcaaagcttcagatagcaatagatctatccaaagatttatccaaatctattctgtttttgtgtttccataacaagagtttgaatagcaaaggatccctgtatttgtattcctccctgtgcaaattgctgattcagatctgttgctttcaggaatatgaaagtaatttaacatttacttcattgtcagtaggttgttggaccaaaggtacttgaaaattggacacttgcagccgggcgcagtggctcacacctgtaatcccagcactttgggaggctaaggcgggtagatcacctgaggtcaggagttcgagaccagcctggccaacatggtgaaaccccatctctactaaaaatacaaaagttagctgggcgtggtggcgggcgcttgtaatcccagctacttgggaggctgaggcaggagaattgcttgaacctgggaggcagaggttgcagtgagccgagatcacgccattgcacaccagcctgggcgacaagagcaaaacttcatctcaaaaaaaaaaaaaaagaaagaaaagaaaattggacacttgctatgtgaatagtaaatcttgtttatatgtcacataaaaagagtatgttgaagagaagtatagtagcaggatgcagagaatatgtggtttgaaaagcacttgatactatatatacatattatatactgtataagacttttgttttgttttttaatgagaaatttatggaactgcttcctggtctaattctattgtagacagctatgactatctccaaaatgcacctcctggattttttccgagacttggtgttattggttttgctggccttattggactccttttggctagaggtaggtgcaattttatggctttaacagtcagctcataaagcagagatagaatatatgtttcattctttcccttcatttaccaggtttcagaataatgagttggttcctaaatacggctttcttaatgtataatggatatggttatcatatttgattttaaacataaatagaaattgtatactcttggtaaaaaaaagaagttatcctttataggcacatttacttgatcaaatctctgttgttctttggtacagaaagagcaaaattttaaagtctttcacacctgagaaatcaactgtttctaaacgtttcactattaagatcaagctatattaatcacagtagatagagcagtgatttaatagagattttattaccttcttgatttgtcatgccttcagtcagtgatgacaaaaactttaaaaatgctttaaatactaacaaatgccaacttaaaaatattactatactgctagattataaaatatctataggaaataaaggctaataaaatactttgctatgatgagatgaatttgttatcaactacttgaagttttgctagttggaaactaaatgtttatgatataaaattctgacattaccatcattcctaatgaagaaagtttatgaatcctgtaatcagacccctgtaaaagagaaccatagagactactctggtccctgtattagtttgttttgcattgctataaaggaatatctgaggctgggtaattataaagaaaagagatgccaggcgcagtggctcacgcctgtaatcccagcactttgggaggccgaggcaggtggatcacaaggtcaggagatcgagaccatcctggctaacacggtgaaaccccgtctctactaaaaatgcaaaaaattagccgggtgtggtggcaggtgtctgtagtcccagctactcgggaggctgaggcaggagaacggtgtgaacctgggagacggggcttgcagtgagctgagttcgagccactgcacttcagcctgggcgacagtgcgagactccgtctcaaaagaaaaaaaaaagaggtttatttggcttatggttctgcaagctgtacaagaagcgtggcatcagcatctatttctgttgagggtttcagaaagcttccaatcgtggtggaaggcaaagggggagcaggcgcatcacatggtgagagagggagctagagagatgccaggctcttttaaacaaccagccctcatgttaactaatagagtgagaaatcactcattcccacagggagggcaccaagccattcatgagggatccacccccatgacccaaacacctcccagcgtgggggttcacatttcaacatgagatttaaaggggacaatcattcaaactgtatcagtcctattcctccaatttaaaaaatcttccctctacatgcaatagcttttactttagtttagtttagtttcgtttcgtttcgtttcgtttcgtttcgtttcgtttagcttaatttgagatagagtctcactctgtcgcccaggctggagtgcagtggcacaatctcggctcactgcaccctccgcctcctgggttcaagtgattctcctgcctcagcctcccaaatagctgggattatagatgtgcaccaccacgcccaactaatttttgtatttttagtagagatggggtttcgccatgttagccaggctggtctccagctcctgacctcaagtgatcggcctgcctcggtgtcccaaagtgctgggattacaggtgtgagccactacacctggccttattttttttttaattgatttcttttttgagacagggtctcactctgtcacccaggctggagtgaagtggtgtgatcatagctcattgcagcctggacctcctgggctcaagtgatcctctcaccttagcctttcaagtagctgggattacaggcgcctgccaccatgcccaggtaatttttgtatttttagtagagacggagtttcgctatgttgctcaggctgaactcctgaactcttgaactcttgaactcctgaactcaagccatccacctcccttggtgtcccccaaagtgctgggattataggcatgagctgccgcacccagctaatggctgttatttttgaatctggagggtagacactgccctggtggcactaccagctcacctgtggaagcaactcatgtcacagtctttgtgccctcctcccatctcatgcagaatatgtcagaattaaatttccagcttatttttgtaatcaacttatgaaccaacatttttccctaaacttctttcacctcatttcttgcaaagctgttcagaagagcattcggtcttatttagatagcgtttgagattgatgaacatcccaaggccagggtgttgggatttcagctatcgttagggagataggaatgtagaagtgagtgagaggagcttccccctccctctcctggttagagcatgtgggaaaatcttccaggtccaaagaaagcactttttctgtgctgtgggtacgttcctacagtgccgagagcttgtccctggaacatccactaggatgaccatcctaaggaggattggagatggtgctctcctggccagagcagcagcatgaggacatctgctacagtgggtcctagtcctctgattttgtttgttcgttctgtctcttttcttccttttcctggggagagcttggtagtattaaaataatttgacaccttaattctttttcacaaatattcacacaggcacgcacacacacatgtgcaatagcaggtcttttctcctgagcgttgggtatagaaagacctgaggtgagcagcatcagaggggttcaccaagcaagatgagtggggtgatagggatgtctgtgggtagccagaatggtttgcaggcccctccaggtgaatgggcccctttgagggcagcagcagggtgggtgggtgcagaaggtccctcctgataggagtttcttttttttttttttgagacagtcttgctctgttgccgagactggagtgcagtggcgccatctcagcctcactgcaaccctgcctcctgggttcgggtgattctcctgcctcagcctcccgagtagctgggactacaggcgtgcaccaccatgcccagctcatttttgtatttttagtagacacgaggtttcaccatgttgaccaggcttgtctcgaactcctgacctcaagtgatcctcccacctcagcctcccaaagtgctgggatcatagttgtgagccactgtgcctggcctggtggggtttcttgagcgtatctgctaaggtagtctgcttcagttgttgaggattgccacaactgtggtggtgacaagaggctctcagagaggtgaatggatgtccattcagaggaagtgggcccagccagaccactccaagatgacacgtggttgttgacactattgttgccttctggtggctctccccagcattggccaccagtggttccccccgcccctggcagtgctgatagtgacaacctgtaccactggcctcttgggagatagggcatggaggtgggggcaggggagtatgattacacctccttcctgaagttcttgggtctctggctcattgtgtgaaccagcaggagctggaggcccgagagctgccacttctcggctctccctggaggagtgagaaatgactgggtggcaggttggctgctctttccctggtcctcacttgggtgagctgcttcaagtggatgggggcaggggaggggccatatgcagggatatcacaggcttttctcttctaggataattataccctttcaattcatgcaacaggatcaggagagaaacagtaaatcattaatagtctaggttgataacatttgtattctcttcagcagtcccagttccatcgttggggatttctctgtttaaagttttaaagccaataaacagtacttatgtgattagaaccgtttaaggattaatgtacacattctgtcggggtacagtggctcacacctgtaatcccagcacttcagaagttcaaggcggatgtatcacctgaggtcaggagttcaagactagcctagccaacatggtgaaacccgtctctactaaaaatacaaacattagccaggcgtggtggcgggtgcctgtaatcccagctacttgggaggcgaaagcaggagaatcacttgaacccgggaggcagaggttgcagcaagccgagatcgcaccactgcactccagcctgagcaacagagcgagaccccatctcaaaacaaacaaacaaacaaacaaatcagccgggtatggtggctaacacctgtaatcccagcactttgggaggctgaggtgggtggatcacctgaggtcaggagttcgagaccagactgaccaacatagtgaaaccctgtctctactaaaaatacaaaattatttgggcatggtggcgcatacctgtaatcccagattcttgggaggctgaggcaggagaatcacttgaacccaagaggtggagattgcagtgagccgagattgcaccattgcactccagcctgggcagcaagagcaaaactccatctcaaaaaaaaaaaaaaaaatcaataacacacacattctgctagcatctatatgggtcccacagcaaaaaacactatgcctctcagtggagtcaaggccatgtgtattctctagtttcatcctctactggtttttttaacctcattctcaggtttctccaggctctgtgtcctgctgtctcttctgtccatttcccttgctccacagctctatatcctcctacaatctggcctgagacttcaacacagttcttgttttgggactggtcttcttcacactttcttgggtttaagcccccttttcctgggttccatgtcatcttctccttggtttactctgccgtgctgttgaactacatgcttaagtcactttcaaaaaagcgtatgttggaggtaaacttcccaagaccttccatgtctgaaaatcactttctgccctcataccatgtgacagtttggttgggcactgaattttgtttgccatcaaaactttcaaagccatgtattctagcatctggcgttgtagatgtgagagtcagtagccattctggatatttgctgcttctgaacaggtgatacattttttttttcttcctggaagctttgaagatcttctgtgaatctttagtgttctgaatttctttggtgctgtgactagatagaagtcttttctttttttttgagacggagtctcactctgtcacccaggctggagtgcagtgtcacaatctccgctcactgcaacctcctccacctctgggttcaagtgattctcacgcctcaacctcccagttagctgggattacaggcgtgcaccaccacgcctggctaatttttgtggttttagtagagatggggtttcaccatgttggccaggctggtcttgaactcctgacctccagtgatccacccgcctcagcctcccaaagtgctgggattacaggcatgagccaccatgcccagccttggatatagtgttttcattcttgcccaaacaatatggcggcttgcagcatccagctgaaggaaaatatcttcttttcctccctccctccctccttctcccttccctgccctcccctccctctctccccttccctccttctccctccccttccctcctccctccccttccatcccctgcatccctccctcccctccctccttctcccttcccttccctccttcttccttcccttctcgtcccgtccctttctcttctcttctcttctcttttctttctgagagatgatctcactctgtcacccaggttgtagtgcagtggcatgatcagggctcactgcagtcttgacctcctcaggctcaagcaatcctcccatctcagcctcctgagtagctgcgactataggcatgcaccaccacacctgactaatttttttttttgtggagaccgggtgtcaccatgttgcccaggctggtctcaaactcccgagctcaagcagtcttccttcttcagcctcccaaagcgctaggattataggcatgagccactgcgcccagcctatcttgtgtatctttgaaaatttactctcattctttttccttcctcaacgcattaattagcaattgagttatttaaaaggaccctatgtgtctcttatattttcttgattattttattttgttccttttgaattttttttgctttggtcatttccaagagctccttcctgttctttgaatgttctttttttcatagaattatttttttcttttaatgtagtggcttttaaaatttatttgatgatacttagtaataggtttagttttgttttgaagttcttctgtttcctttgtgcttgtcttggtctttctcctttatgtttcaggctttccacaaatgactggtgattcttggttatccagtcatgtttcaaagtgaggcagctgaaatgctaataagaactctttcacctgtaatcccagcactttgggaggctgaggcaggcggatcacctgaggtcaggagttcaagaccagcctggccaacatgggaaaaccccatctctactaaaaatacaaaaaatagccgggtgtggtggagggtgtctgtaatcctagctactcaggaggctgaggctagagaatcacttgaacccaggaggcagaggttgcagtgagctgagatcacgccactgcactccaacctgagcaacagagcaagactccgtctcgggaaaaaaaaaaaaaaaaaaaaaagaactccctgtctgtacatggggcccactgacgggcaggttctacctcaggggagctgggcaggaagtgaccatatacaagggtgcacccagggccagtgtgaggagggcttttctctcaggcactgacatactcaccccttccagctctcttggttctcagcaggaaatccatggtgtttctttagtgataccctgcccccactgttttaactcttttttttttttttttttttttgagacaggatcttgctttatcacccaatgtgttaggccattcttgcattgctataacctaacactgggtaatttataaagaaaagaggtttagttggctcacagttctgcaggctgtacaggaagcatggcaccagcatctcctcggcttctggtgaggccttgggctgcttgcaatcatggtggaaggcaaagggggagctggtgtctcacatggcaagagtgcgagcaagagaaagaggtgggggaggtgtcacacatttttaaacaaccagatctcaagagaactcactgttgcacaaggacagcaccaagggaatggtgttaaaccatctgtgagaaatccaccttcatgatcaggtcacgtcccaccaggccccacctccaacattggggattacaatttaacatgagattcagagagaacaacatccaaattatcacccaggctggagtgcagtggcatagacacagctcacagtagccttgaactcctgggctcaagcaatcctccagcctcagcctcctgagtagctaggaccacaggcacatgccaccacaccttactaattttttaattttttgtagagatgtggtctccctaagttgcccaggctggtctcaaactcctgggctcaatcagtcctcccacctcagcctcccaaagtgctgggattacaggtgtgagccactgcatcaggctcattttttttttttttttaaaggaatagagatggggggctgggcgtactggctcatgcctgtgatcccagcactttgggaggctgaggcaggtggattgcttgagctcaggagttcaagaccaacctgggcaacatgaggaaaccccgtgtctacaaaaactacagaaaaaaaaaaaattagccaggcatgatggcttgcacctcttgtcccacctacttgaggggctgaggcaggaagatagtttgaacctgggaggtcgaggctgcagtgagccatgattgtgccactgcactccagcctgggagaccgagtgaggccctctctcaacagaaaaaaaagaaatggagatggagtctcgctatgttactccagctggtctcaattcctggcctcaagcaatccttatgcctcgacctccccaagtgctaggattacaggtgtgagccaccacacccagtaaccctggtttactgggttttttaacattttgaactggtgtgacttcctggccaggggtagttttgtactgggatggcataggggaaggaaaggccatgctggtccatgcatcggacttgcgtttgtcctgtgcccttgtcttgctccctggttgccatctccactccccatggtacctgccatctctggatctggaatctccctggggctgcctgggacagatctgctccctctgaggctgcactcctcctcaagatttcaagatttcaaggcagtgtgtcctcttatttccgttcactctccattttctgaaaattgattgacacttcctttctgccagtggcccttccacacattttctcttcattgtgggtttattaatgttttttcttactgtttttttaacggggttgcagaaaggggagaagaagaacgcttgtgtttagtatttatataggaagccagattgctataaaagaacataaaccctagaaaccaaaatactcatttgtttatttttaaaataatctttttttctgctctcttagggaaaaaaaggtgttcttttgaaaacacttggtgctgagtgaaagaagccagtcacaaaggaccgtatatttactgcatgattccatttatatgaaatacccagagggccgggcgcagcggcttacacctgtaatcccagcactttgggaggccgtggcgggtggatcacctgaggtcaggagttcgagaccagcctggccagcatggcgaaaccccatgcctactaaaaatacaaaattagccgggcatggtggcgtgtgcctgtaaccccagctactcgagaggctgaggcaagagaattgcctgaacccgagaggcagaggttgcagtgagccaagattgcgccattgcactccagcctgggtgacaagagcaaaactctgtctcaaaaaaaaaaaaaagaaatatccagagtaggcaaacacatagagatagaaagtagatcaatggttgcctagggctggacggtacgggggagttgaggaatgactgctaatgggtttcttttagtgattatgaaaaagctctaaagttaattgtaatgatggttacacacctctgtcaatatactaaaagccattgaactgtactttaaatgggtgaatatgaattttatctcaataaagcagtgcaaaagcgttttggtgcacatgactttatttggcacattctttcagtttaggaccaaagaaatcttattcagtggtggggttattttggttttgttgtttgggtttcttaagagacacggtcttgctctgtcacccaggctggagtttagaggtgtgatcatagctcattgtaacctcgaactcctgggatcaaggaatcctcccacctcagcctcccaagtagctaggactataggcacacactaccacgcctggctaatttttttattttaatctttgtagagacaggatctgactatgttgcccaggctggtgtcaaactcctggcctcaagtgatcctcccgcctcggcctcccagagcttttggattataggcgtgagccactgtgcctggccttgttccgtattaaatggataaggtaaattgtgatggtgaggataatgaatcatctgatggcgtgtacaaccttttatttatcaggttcaaaaataaagaagctagtgtatccgcctggtttcatgggattagctgcctccctctattatccacaacaagccatcgtgtttgcccaggtaagagaaactctgtaatccatgatgtccctcattcttgtttgtgtgtgtatgaatctgatgcttaattttattttattttgcagttcttataacaccagactaaaatttgtttgtacatatagatgaatacagaaaatttaaatgattttctccactatatgcctcagttctggcccttcttccagtaatgccagtgttcacagaatttgaacacgaatttgcgtgattgtttgaatgttcatcagcaaaaatttaatatacattttttgtatacttacatggaagtctagagactcaaattccaaagctgataattatgggtcactcagtttatgcatgtccggtcacaacctgctctcgttggtattgtagacccagactactctgacttccactcctccctagtactggtgcccttgctttccttgctggggactttggggactgtaatcccctctgcttggagtgcccttttcggggctttcagttggctgctcctttcttatccttgaagcctcagtcttatggtaccctggcaagcaggtctatcacggtggcaggcaacatggataaagctgtaccaccgattcttaaaatgtgttaccagaccagaagcagcagcatcacctgagaacttgttagaaatgcaaactctcaggccccaccccagactgactgaatcagaagctctgggagtaagggccagcagtctgtgttttagcaagccctccggtggtttgttattaatgcctatggtgtttgagaaccactgatggagaccagtaggtagcctgaaaagggtgatatctggagtgagtgggactctagagatggtgtccctcaggaactggtaagaacaagacaggctctaggttttgaggtcctgggcagattgtggacacagggactttagctgctggaactaccacatcacatggaaactcagttccaggagcagacagcagtgcagtcacccaaattggactctgagccagactgacctgagactgagcttccttggttgttcatgacagtattgaatccagattccttgattgggctacagttgtatgtgagagtccagtggccccagcttggggagcttgatggctttgatgacaaataccagtactttccagcatttgctcaacattgtttgtaacagtcctggaggcagatagttaatgcttctgtccctgctccagccccaggtcaggaacagtgagtaacatcttccagccctagatataaaaataattaaacattatttcagcctgttatggtttaagcagtaaatagctagagtggagagggtgaacttggttgctcgttgagaagcatatgtggctgtccccagagtaggagtcttttttttttttttttaaatttctttcttttttaacttttagcgttaggtgtacatgtgcaggtttgttattgtaaatcgtgtgtcatgagggtttggtgtacagattattttgttacccgggtaataagcctagtacctgatgggtagttttttgatcctcgccctcttctcaccctccaccctcaagtaggcctcggtctctgttcccttctttgtgtccatgtgttgtcaaggtttagttcccaattacaagtaagaacatgtggtatttggttttctgttcctatgttagttcacttaagataatggcccccagctccatccctgtccctgcaaaggacatgagctcattctttttggctgcatagtattctgtggtgtataagtaccacattttctttatcaagtctaccattggctgggcatgttggcccacgcctgtaatcccagcactttggaaggccgaggtaggtggatcacctgaggccaggagttcgagaccagcctgaccaatgtggtgaaaccctgtctctactaaatacaaaaaattagctgggtgtggtggcacatgcctgtaatcccaactacttgggaggctgaggcaagaaaattgcttgaacccaggaggcagaggttgcagtgagccaagattgcgccattccactccagcctgggcaacaagagcgaaaactccatctcaaaaaaaaaaaaaaaatctaccattgatgggcatttaggttgattccatgttttgctattatgcatagtgctatgatgaacatatgcatgcatatatctttatagtaaaatgatttatattccattattattcccaataatagggattgctgggtcagatggtaagatcttttctattttgttttaaggtcagtggggagagattatatgactggggtttacgaggatatatagtcatagaagatttgtggaaggagaactttcaaaaggtgaggagcatctttttcattatcttccttttggtttaaatatgtggtttctctagggttttgtaaaatatttgataaccctgttgatttattgctttttctgtttgcttctagttctgtctccagctcagatttttcaggtgacctttcttggtagagcagtagaacttctgagtatttggttattatcagcagggccaaataagtggtgaccataaaatgcaatgcattccaccgtagtcttagaccatattttccattatattgtattcctagtttcctctaagtgtagcgtattatttaaaagtcttattgaaactgaattcaaagggaatgtactatgctcccaggaaaaagacataattgagagcctcttcctcttggtttttcacttatcatgagttctgttctttccttagcactgctgtttctgtttatcccccaggcttctcagctcagctgagggtgtgagccatcgtatgttggggactagctaccagctaaaggccacgttctctgtgctgtctagtacatgagcaacagagggaagaagttgtgtaattgtaagaacttgtcacctttcatctcttttagtggccacatagccgattaaatgttgcctatgttcgcttggaacattcccttcctcccactgataaggaagaatgagtagagaataaggtatcatgtctctactaagcactcagaggcacagccagctaaggaagaattagacttcttatattaatataccttctacatcacagattgaaggaagttcatttttcaatgaaaatactttttaaaaaaaaataaataactgagcttcaaatcattgacaagttaaaaaaatacatataaataactatctcagaattaaaatccagaattttgaactgggatttggaagtaacagaataaattataagccctctttattatttacataaataatcttctagtgaaatcttaagactcattttttggccaggtgcagtgactcacgcccagcacattgggagtccaaggtgggaggatcacttgagctcaggagtttgagaccagcctaggcaacatagtgagaccctatctctccaaaaaataaaaaatttagctgggcatggtggcatactttgggaggctgaggtgggaggattgcttgagcccagaaggtaagggctaaatagagtgagccatgattgcgccactgcactccagcttgagcaacacagtgaggccctgtctcaaaaaaaaaaaaaaagaaaaaaagaaaaaaaaccccactaatttttatactggtggtttctaaaggaattagtccttctcgagcctatttaaactagctcttgaataggaaattctataccaatatcaagagtcttttggcaatccctgtttttttgattgttttttgttttatttctctgatattttctatggaagcttcctttcctttttaaaaaattccttaacaaatgcggccaggtgcggtggctcatgcctgtaatcccagcactttgggaggccgaggcgggtggagcacctgaggtcgggagttccagaccagcctggccaacatgatgaaaccctgtctctactaaaaaaatacaaaaattagctgggcatggtgatgcacgtctgtaatcccggctactcaggaggctgaggcaggagaattgcttgaacccaggaggcagaggttgcagtcagccaagattgcgccactgtactctagcctgggcaacagagcgagacttcatctcaaaaaaacaaaaacaaacaagcaaaaaaacaaatgcacactaaattttatatgggaaaggaagtaaaatatcaagaaatctctaaacagccctagacagaaatgtggaaagtgagactaaaagcctcaactgcgagccttcattgtggtgtgactgcagactgaagcacaccaaagccagagggagtcccccaggctccccggagtgctcactgtggtgtctgtgcagacacacacgcacaccaaagctaaagtgagggctgcgggagcctctggcttggaaacagcattctctgactgtgctaagaattcagcccagtgcagaagcagctggactgtggttaggataccagttaagcaggccaacattttctggtcatttgaagacattagatattaaagctacccaaatttatatgcagatctttttagagtgaggtggtaaagatttttaattagctcatgattggtttgcatttctctctgtctttatacccttgccttcttcagagtcattgagaacttaaggctttctcctgtttgttactctccaaggataattttattgacagctgtctgttctcaatagaaggtaataaaatcagggccaggcacagtggctcatgcctgaaatcccagcactttgggaggctgaggcaggcaaatcgctttgagcctaggtgttcgagaccagcttgggcaatatggcaaaaccctgtctctacaaaaactaccaaaaaaaaaataataaccaggtgtggtggcatgcacctgtagtcccatctacttgggaggctgaggcaggagaatctcatgagcccaggaggtagagtttgtggtgagccatgttcaccccactgcactccagcctggtgaatgggagtgaaaccctgtatcaaaaacaaacaaacaaacaaacaaaaaaaaaaaacggtcgggctcggtggctcatgcctgtaatcctagaattttgggaggccgaggtgggcggatcacgaggtcaggagatcgagaccatcctagctaacacggtgaaacctcatctctactaaaaatacaaaaaattaatgttgactgcattaaatatttattacaagttttaaaggaaaaatagcagaaggccctattaattcaaaattcaatattcttaaatttcaggaattacttgatataatgaagtggcattgttttttgttgatcttgcttcaccccccccactttagatttcatgggcttcagggggatttttgttttttattttttggtttatttatttatttttgagatggaatcttgctctgttgcccaggctggagtgcagtggcacgatctcggcttactgcaacctccacctcccgggttcaagccattctcctgtctcaacctcctgagtagctgggactacaggcgcacaccacaacacccagctaatttttgtatttttagtagagacgggttttcaccatgttggtcaggctggcctcgaactcctgaactcaggtgctccacccatctcggcctcccaaagtgctgggattacaggcgtgagccaccacgcccggccttgtttttgtttttttaatgagagctaagatttaagctaccctggaaaatgaatctttctggggccttggagctgagtatattctcttcatagactatcaaataattcaaaatctagtaaaggagataaggaaagcatatgaccaaaatacaagataaaatgtgataaatgccagaagaaaggcacacacaaaaatgtatgatttttggatgaagatatcttgtcttcattgaagggaattaagggacgcttcatgaaggggacttttttgtttcttagcttgttaggaagttggttttcaagtccagctttaattaccagtctcaattaagtatcatctaattcatattttttttttttttgagacagagtctcgctctgtggcccaggctggagcgcagtggcacgatctcggctcactgcaacctccgcctcccgggttcaagcgattctcctgcctcagcctcacgagtagctgggattacaggtacatagtaccacgcctggctaatttttaatagagacggggtttagtatttttagtagagatggggtttcaccatgttgtgcagggtggtcttgatctcctgacctcgtgatctgcccgcctcggcctcccaaagtgctgggattacaggcttgagccaccgtgcccggccaattgtttgtattctaatcatgtaacagatgtactggcttttggttgtacatagtcagagaaactgtggacactatgtttaaaacagggtgctggccaggtgtggtggctcacgcctgtaatcccagcactttgggatgtggagacgggtggatcacttgagcccagaagtttgagaccagcctggacaacatggcgcacccccgtctctactgaaaacacaaaaattagccaggcatggtggcacacacctgtaatcccacctacttgggaggcggaggcacaagaatcacttgaacctgagaggcggaggttacagtgagctgagatcgtgccactgcactccagcctgggcgaaagagcgagactcggtctctaaatacatacatacatacataaaacagggcactgaaaatttttaaattaggaatgatggcacaattcttaacggtattatttcccatgggggtatattactctgaaatatcccaaacaggtctgtggcattttgctgctctgccacatcccttttccctcttacgaaatgattctaaatgtttgtgctgagtcttctaccaataaagtagtgtttcagtctgtcatcattggttacttaagaggaatttatctgcttcagttaaaatgaactttttgtcagaactatgaagcaaagataggtgtgtccagaaatattgtcatcttggtacagtctagggctttcttttaagttacaagaatatataacatatgtatagtttaaaatccaacactataatgaccatgtacataccaaccaattatctacctttaaaactaggaaattaccgtggggcgcggtggctcacgcctgtaatcccagcactgtgggaggccgaggcaggtggatgacgaggtcaggagttcaagaccagcctggccaagatggtgaaaacccgtctctactaaaaataccaaaaaattagccaggcatggtggcaggtgcctgtaatcccagctactcgggaggctgaggcagagaattgcttgaacctgggaggtggaggttacagtgagccaagatcgcgccactgcactccagcctgcgcgacagaacaagactccatctcaaaaaaaaaaaaggaaattaccgatgcctttcaagtcttccatgggtcccctcacccccaagtctccccagagggaaccattatctggaattttatttcattcccttgtttttctttaaacttttcttccagtttaaccatatatgtctgtattctgaaatactattgttgagcctgcctgtttttgcctttataaaaatataccaaatttaagtctaaatatacatattatatatatataagtttatctagatgagtcttactacatattattttgcaacttgttttgttcccttaacattttgtttatgggttatgtatggcagtagtgtattcatcttcactgctgtagactattttctttgtgttgttgttgttgttttaatagacggagtctcactctgttgctcaggctggagtgtagtggtgcagtcatgactcactgcaacttccgcctgctgggttcaagcaattctcctgcctcagcctccagagtagctaggactacaggcatgcgccaccatccctggctaatttttgtatttttagtagagacagggtttcaccatgttggtcaggctggtctcaaactcctgacctcaggtgatccgccctcctcagcctcccaaagtgttgggattacaggcatgagccactgcgcctggtcatattttctttatgggaaaatacccatgttggtggctccttgggtgggtttcagtatattactattacaacacagcatggcttcataatttgtgaagaatttttctagaccagggttcctgattcatagggtctgcatatcttcagttttactagatgatgccaagtaattgttaccatttttgccagtgtgatggctttaaaagagtttttcatcatggagtatatgtgtatgtggctttactttatttcccaattttcattttgagaaaatttcaaaactacagatcaggtgcaggactagtacaatgaatatacccttcacttagattcactaacatttgctgcatttgcataatctatcttttcacctatgcatggtgttcatacacacgagtatattttattttcctgaaccatttgagaattaattgtagatatcattgcattttccatctgtatctaattcagcatgtatttccaaagaacgtggacattcatttatatgatcacaataccgttattgtactcaggaaagttggcatttcattatttacacaaatgttatctaatatatagcccatgttcaaatttccctagttgccccaataatgtacttgccttaaacaacttttgattttttttttttttttcgagatggagtgttactctgtcgcccaggctggagtgcagtggcgtgatgttggctcactgcaacctctgccttctgggttcaagcaattttcctgcctcagcctcgcgagtagctgggactgcaggcgcacgccaccgcccccgcctaatttttgtatttttagtagagatggggtttcaccatattggacaagctggtctcaaactcctgacctcaggcagtccacctgcctcggcctcccaaagtgctgagattacaggtgtgagccaccatgcccgaacttttttttttttttttttttttttttaagtctctcttaatctacaggctccccttccatcttttggagttgacttccttacagtttatctgttaaaacagtctggcacatttcacctatagagtttccaacggtttgggttttgctgattacacatttatgctatagtttaacgtgttctctgtactccctgcacattggcagctggatgcacgggctacttgaaccagatcctgtttgatccttttggcaatgctctagatccacgtaggcacataagtctggtttttgctttgtttttattggttttagcagctgtagatgctcaatgcctagacccattgaatctttgggggatagaaatggtgatattggccgggcgcagtggctcacacctgtaatcccaacactttgggaggccgaggagggtagatcacttgagatcaggagttcgaaacctgcctggccaacatggtgaaaccccagctctactaaaaatacaaaaaaattagccacacatggtcaggagattgagaccatcctggctaagacggtgaaaccctgtctctactaaaaatacaaaaaaattagccaggcgtggtggcaggcgcctgtagtcccagctactcaggaggctgaggcaggagaatggcgtgaacccaggaggcggagcttgcagtgagctgagatcctaccactgcactccagcctgggcgacagagtgagactccatctcaaaaaaaaaaaaaaaaaaaaaatcagccgcgcatggtggcacgtgcctgtagtcccagctactcaggagactcagtcaggagaattgcttgaagctgcaaggcagaggttgcagtgagccaagatcatgccacctcactccagcctggttgacagaacaagactctgtctcaaaaaaaaaaaaaaagaaaagaaaatggtgatattttgcttctattgtttcattttctcaaattagctgaaatattttgataaagaaccccttctcttatctactagttacccagttatagtttatataggaaaaacaagataattacttgatttttttctcttatttatccagtttcaaaataatgaattcattccctttcctcagaagatcacctgttagtttttctttaaaaataatggccaggcacggtggctcacgcctgtaatcccagcactttggcaggccgaggcgggtggatcacctgaggtcaggagttcgagaccagcctggccaacagggtgaaaccccgtctctactaaaaataaaaaattagccaggtgtggtggcacgcgcctgtagtcccagctactcaggaggctgagactggagaatcacctgaacctgggcggtagaggttgcagtgagccatgatcgcgtcactgcactccagcctgggcgacagagtgagattttgtctcaaaaaaatagggccagacgcggtggctcatgcctgtaatctcagcactttggggggctgaagtgggcggatcacgaggtcaggagatcgagaccatcctagctaacatggtgaaaccccgtctctactaaaaatacaaaaaaattgggcgtggtggcacatgcctgtagttccagctactcgggaagctgaggcaggagaatcgcttgaacccaggaggcggaggttgcagtgagccaagatcccgccgttgtactccagcctgggcaacaagagtgaaactccatctcaaaaaaataatataaataaataaatatatatatatatttatatagagatggatatatatgtgtgtgtgtgtgtatatatatatatatataattataggctgggcacaatggctcacacctgtaatcccagcactttgggaggctgagacaggaggatcacttgagtctaggagtttgaggctgcagtgagcgctgtgttcgtaccactccactccagcctgggtgacagagcgagaccctgtttcttttcttttcttttcttttttttgagatggagtctcgcactgtcgcccaggctggagtgcagtggcatgatctcggctcactgctagctctgcctcccgggttcacaccattctcctgcctcagcctcccgagtagctgggactacaggcacgcgtcaccacgcccagctaattttttgtatttttaatagagtcggggtttcaccgtgttagccaggatgatctcgatctcctgacctcgtgatccgcccgcctcggcctcccaaagtgctgggattacaggtgtgagccgctgcgcctggccaagaccctgtttcttaaaataataaataaattaaaaatcattacgggtttatagatttaaacatatttgatagttttgaatgctttgtaattcttggtcttattaaagttcaaactgtcccattttgctagtggaagttggctctgagtcctcttgacatgacccaagtagtctgtgatagttacctcactatctagcatgtgaagatgttcccagaatttcccatcgtggttttcatttacattgccctgattgagcatcttttcacaggtttattggcttcttcttgaaatgcctgttcatgtcttttggccactttttatatgggtcatttgtcccttattgatttataagggttctttatttttttcctagatattaatagttttggccagatgtttgcagatgtcttttctcaatatggcttgtcttttcagttttggtgtcttgatgatcagaagaagttcttcatgtagttgatttattgaccttttccattatggttttcactctttgactctaggagcttaataaaagcatgaaatatttattgattgtccattgctaatccgaaaccctttcagaatagtcctaacccaaggtctcagtatcagagatgaaggccagttgtgggtgtcaggaggtcagttgtgggtgtcagtcctcagggtcacagatggctcttttagagttgtcttttttttttttttttttttgagatggagtcttgctctgtagcccaggctggagtgcagtggtgcagtggtgcgatcgcgttcactgcaacctccacctcctgggttcaagcaattctcctacctcaggctcctgagtagctgggattacaggcgtgcgccaccacgcctggctaatttttgtatttttagtagagacagggtttcaccatcttggccaggctggtcctgaactcctgacctcaagtgatccacccgcctcagcctcccaaagtgctgggactacaggcgtgagccactgcacccgactagagttgtcttttttttttttttttttttgagatggagtctcgctctgtcgcccaggctggagtgtaatggtgccatcttggttcattacaacctccgccttctgggttcaagcgattcttccgcctcagcctcccaagtagctgggattacagtcattcactactatgcctggctaatttttttttttgtatttttagtagagacggggtttcgccatgttggccaggctggtctcgaactcctggcctcaggtgatccccctgcctcggcctcccaaagtgctgggattacaggcgtgagccaccgcacccagcttagagttgtcttataattagctaaacacagcagtatgtctcagtaaatatcatattttagtttttcactagcttttttttaatgcaacaaattactatcacagaattgtacaatgactgctgaaggccaacactaattatttaaaaggcaggaaattaataaagaagcataaacctgttaccaatgtgaaaactgagcagaacttctaaagctgagctgttaatagttttattcaggcccttgctggctcagcaggaaaatgaaagggaagcagcagccaccaccctgagtaaacatgccctgctttttcttcctccattagaagttcctcggctctctaaacatggcaaagtttggctgaaagtaagtcatgtagttttaaaatgttcatctttgaagtaagctaatcacagaaggacaattactgcatgattctacttgtatgaggtatttaaaatagtcaaactcatagaggcagagaatagaatggcgattgccagggattgggggagggagagatagggagttggtaatcaacaaagttttagtcaagcaaagagaataagttctacagaccccttgcacaacactgtgcctatagataacagtaccgtattgtacacttaaaaatctgccaagagggcagatgtcatgttaagtattcttaccactgtattttttttaaatgacagcttgatgggttttccataaagttatgagtttgtgctttgtaattttttgctgtctaaaattctaagaactacaggtattaggaaatgattttgaaatgattttttctttctttttaaaaacaccattatttaccaaaatgaaaagttagaaatcctgaataatgtcatctcctctttagaaaggaatgcactcttggtatcagtgggcaggatacagcgttgtccagtggactaagaggagcgggagcaccagactcctaccccacctctgcctcttactagccctgaaaccttgggaagttactccagctctgtgggaactggcatagtacctcctggagctgttttgaggattaaataaggttatctcatgtgaggaacatatgaaatggctggactctagccacatgatagtcatcaaccaccactcatgtgatactgcacattttcgcttctgcctgagaagataatgtccactgatagaaaatggaaccataccctgtagtcaggaatccttatgtcattgttttagttttccattgctgccaaaataaatgactgcaaatttacaggttgaaagtagtgcaaatgattatcttagttctgtgggtcagaagtccaattctaaatcaaggtgtcagcagggttgcgttcctttctagaggccctaggggggaatttctttcctgctcatttagattgttgacagaactcagttcctcgaggctgtaggaccaaggtctgttttgctggctgagggctgtttccagcttccttcctctattgtcgaagcctgcagcaagtcgtttgcagatcccccttctgacctcttcttctgcctccctcttagactgcaggcactcttatgcttgaatcaagcccacccagataatccaagatcatctccctattttaagggcaactgattagtaaacttaattccaatgcaaccttaatttccctttgctgtgtgaggtaacagtcacaggttccagaaatagaagacatctttgaggggccattattctgcctacctcatcaagtgaactagaattgtgttggggtctttaacaggtcatttatccttaccttttattttcttcatccaaaaaataaagtggcctgccatataggatagataatgtttattgagcacttacttgctgtgagcttggcccttggcgctaaactctttgctcaggaagagtctttgaggtgggttctattattatccccatttataagtgaggaaactgcattttggagaagttaagtaattgttgaaaataattcaactggtgagggagtcagacatttcagtaggctgctgtacctcaaaggtttggctggctggcaatcagccttcacatggcaggcatactaattagaaatcagtgtcttgattttcttaaaaagttttggttttgctagcagaaattgtcatttgtgcccaggcacggtggctcatgcttgtaatcccagcactttgtaggccgaggcaggcaaatcacctgtggtcgggagcttgagaccagcctggccaacatggtgaaaccctgtcttcactaaaaatacaataattagctgggtgtagtagtgggcgcctgtaatcccagctactcaggaggctgaggcaggagaatcgtttgaacccaggaggcagaggttacgtgagctgagattgcgccactgcactccagcctgggtgacagagggaaactccgtctcaaaaaaaaaaaaaaaaaaaaaaagaaattgtcatttgtgttcatggacgtggtaagaaaataaaaactgaaatcagatatgtatgaaaatgagttacaaaatattctagataaaactttctctgtctgaaaatgcaaaaaaaaatgatttctggcttgtgctaaatcacgaactgttttttgaagtcagaatgttgttttgtctgagatcctggagttctctgccaagagagatctgatttgtgacagggtggtggatgggctcaatatttttttaatgagatattggactgtgctgttttgttatactataagtgatatgtaaccaaacaagaaaattttcctagcaacaaagttgttttcctgaatcagaagaatgcttttgtgtgctcattttcttattgtccaaaagataaaaaagcttgtgaatttagcatcttatttttttgagattgaggtactggcgagtatagatagtagaatatataagaatatcattggaagtatttggcaagcagtatgttaattcagacctaaactgtatttaagtagagaactaacttgtttttttgtttgtttgtttttgtttgtttttgagatggagtttcactcttgttgcccaggctggagtgcaatggcgtgatcttggctcactgcaacctccgcctcctgggttcaagcgattctcctgcttcagcctcccgagcagctgggattacaggcatgcgccaccatgccctgctaattttgtatttttagtagagacggggtttctccctgttgttcaggctggtctcgaactcctgacctcaggtgatccacccaccttggcctcccaaagtgctgggattacaggcgtgagccaccacgccctgccgagaaccaccttgtttttatgccagacccgattgttggacatgattatctcactggcccttataagcctttttttctctcttcttgttcttcattagtctggtgagggacccagacatttcagtaggctgctatacctcaaaggtttggctggcaatcagccttcacatggcagtcatactaattagaaatcaatgttttgatttttttttaagttttaattttgctaacagaaattgttattcgtgttcatggatgtgttaagaaaatagaaacccaagcttttttacattcatcagatctctaagttctaccccattccatttgtttgtttgttttgagacagggtctcactctgttgcccaaactgtagtgcagttgtgcagtcacagcttactgcagcctcaacctccctggcttaagtgatcctcccacctcagcctcctgagtaggtgggaccacaggcatgtgtcatcccacctggctaatttttgtattttttttagagacaggatttcagcatgttgcccaggctgatcttgaactcctgggctcaagtgatccacccgcctcggcctcctgaagtgctgggattacaggtgtgagccactgcccctggctttccatttgtttatgcaacaaatatttgaatagtgtgtgctaggaggccctagggatattgtgccctcatgaagcttacaggttaatgaaagactcaaacatgaaagaaataattacacaatcaggaagtacatgagtgctatgaaagggaatagaaggttctgctaaattgaaggacagggtacaaagaaagccttgatgtaaaggatgaataacatttagctaggcaaaaattgggattgtctggtctcggtcagtggggtatattttgcaaaggtcttgtcccagtagggagtttgtcaatttcgagcaacagcaaaaaggcctctgggttgtaggtgggtgtgtgttcacatatgggtatgtgtgttcgcttgtgtgcatgcatgtgaggaggcagggtggggagtggctctggaggaggagaagggcacagattctcagtcctgtagcactcttgttcagagcatcaagtagacctgagaattgtatgttgatcattggtccgccaagcagttcgtatggccttgtttcccagaactccatcatcaagtggatgtggtgaccatatactttatcatcaaaaccaggatactctttttttttttttttttttttttaaacttctttttctatgttgcccaagctggtcttgaattcccaggctcaatggatcctcccgcctcggcctcccaaagtgctgggattacaggcgtgaaccaacatgcccggcaaaccaggatactcttgagagtgaaaggggacactattaattatgttgggacaacgggtataaaacagtacttatagaccagttctcagccactccagggagccccaaagttgcctagaaaccatgctctgaaatgacagggttagtcacgtgctcctgctttctcaccttttcctcttccttcatccatgaataactctgaaagaggggcaccaggagaaactgctccaagtctatacaacagaatcttagcccccatggcccgcccagctgcagcctcctgtttttcagactgccatctgatctctgactattaatgtgttttcagaattaaagtctaaaaaacgtatagaaaagaaagtaaggccttaaaagtttagcacgtgaacttttcccactagaagcttttcctacactgcttcttatggattacatggcctaattatatgttcccggagggccactgggcagaatgggtgtggtctaacttctttcagagtaaacatgttttgtggattggcccctatggtggataatggtgaataatgcatggagtaaatacctacaggaagccttcccataggtgtaaaacctttatttcaggaaataaaaggaagatatattgattttttaattagaatcaactgtttggctgaatctgcataatgaggattaatggagctttatttcctgctctctctgcccaagtcactctacagtagggccctcagagagccctagtaacttcttcaatttactgacagatggatcactttgcagtaaaataatatttaatggtcggtaactgcgagaatgtgggatctcattgtcctcctcagcctttcttcaacaaccccccaagtcctcaataaaatggtttgaccctgtcccccataataatttttaatgttcatgttcagccaaatactcaggacactaaggagttgcactatttcttttcaaactgcattcaagctctttcttttgttttaaaagccaggaaatgtgaagaattcacctggaactaagtagaaaactccatgctctgccatcttaatcaggtaaaaaacaagaaatttctgtgattattttcagcattgtagtgccagctgaaatgacttgtttttaattaatttaatttaattaattataacagtttcaatttgatgtgaaaatattttattccatcttttagtttctgggcttaaatgctgtgacttacttatttgtgtttgttccactaatgttacctgggttttttagacaagctagaaccagacagttgggatttgtctacaaatgtatttcaaacaattgaaaagtgtcattattccttaggtttttttcaaacaacactttattatagtaagtacacttgtatttatctaatactcagtgaacactggaatgcatgactgttacagagaggctcaaaacactagttatattgtttgtgtatatatgaaaaattgtataatagcacttgtgatttcctggtaattagaagactgtaattgaatttggaagcaacctagatattcaactacaggaaaatggcttaattatggtatatctataaagaagaatattattattctgtttctacagtatttaattgcatgggaacgtgtgcacaattattgttaaatgaaaaaaaggtagtgtgatatgtttatagaggggatgaagccaggagatacgacagaaagtgtgtatctttcagtggcatgatgatttttatatttttttcttctttataactttctgtatttaaaaaattttctgcaatgagtatgcattttataatcagaaaattttttgaaaattggtgttacatttattgtaaatcatggcccttacttaaaatttatgaaaaccctgagtttgaagggtcttttttcctcaagctttctttatatttttggagacccaaagagtcacataaactgagaatttgagagtggttatctggcccaacccccagcctcaagcagactcccctgaaaccctgtatgttccttcttttacaccagcactgatgggaaactcaccctatggggcagccatcctgggacaattctgagtttttggaagctgtttcctctgctaagcaaaaatatgtctccttagtggtcacagaaaacaaatccagttcctctttcacagcatagctgttcatacagtaacccaacatcagtatgttctcagatacaaactattacccggggagcttggtaaaaggcaaagggcaccccagaatcagtatctctggtgaatggggccagatatgcatgggatgtgccattagaaggatgactggagggtgagcagccacagagtgacacatgtcctctagagacttgacttttaatatggttatatttctctctttttttaaatccctgtcagccagaatggatatatttctgtacagggacaatgaaaaagacatagaataaagggaaattaggtaaatatccatttcaattttcaaagatactctgcaccagagttcagcttgctgaaatacacaaccttgacttcattctttattgtttttagatctttattggaggaggtgtagcttttaattataaaagtgattcgtgttggttgtaaaaaatgtttttagctaactgttttaaaagcttgtcttggccgggtgtggtggctcacgcctgtaatcccagcactttgggaggccaaggtgggcagatcacgaggtcgagagatcgagaccaccctggccaacatggtgaaagcccgtctctactaaaaatacaaaaaaaaaaagccaggcatggtggtagttgcctgtaatcccagctacttgggaggctgaggcaggagaatcgcttgaacccaggaggcggaggttgcagtgagccgagatcgtgccattgcactctagcctgggcaaaaagagtgaaactctgtctcaaaaacaaaacaaaaaagcttgtcttatcctttattcttttctttttctttctttcttttttttttttttttttttgagatagagtttcactcttgttgcccaggctggagtgcagtggagcaatcttgctcactgcagcctctgaggcctcccgggttcaagtcattctcctgcctcagcctcccaagtagctgggattacaggcatgcaccaccatgcccagctaattttgtattttttagtagagacagggttttagcatattggtcaggctggtctcgaactcctgacctcaggtgatccacctgcctcagcctcccaaagtactgggattacaggtgtgagccaccacatctggcccctttattcttttttccagaggtaatttttgttaatagtttggtatatcattccagacttttaaatatagatagatagatagatagatagatagatagatagatagatagataggccgggtgcagtggctcacacctgtactcctagcactttgggaggctgaggtaggtggattatatgagtctggcagttcgagaacagcctgggcaatatggcgaaaccctgtctctacaaaaaattaaaaaaattagctgagtgtgatgacgaacacctgtagtcccagttacttggaggctgaggtgggaggatctcctgagcctgggagaaagaggttgcagtgagccatgatcactccactgcactccaacctgggcaacagagtgataccctgtctcaaaaacaaatatatatatttatttatatttaaaatttatttataaattaaataaatttatttatacatttataatatattcatgcatacatgcatgtttttggttttttgacaaaatgggatcatattccacatattgttttacaagttcacagaaaactttctttttactgttatttatctggggggatgggatcttgctgtgttacccaggctggacttcaactcctgggtttaggtgatcctcccacttcacccttctgagtagctgcacagaaaacttactgaaggcatataattgtaattatattatcatacataaagaaattaggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaattttttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggggaaaaaaaaaaaaaaaagaaattaggctggggctgggcgtggtggctcacgcctgtggtcccagcactttgggaagctgaggtgggcggatcatgaggttaggagtttgagactagcctggccaatatggtgaaaccctgtctctactaaaaatacaaaaattagccagacatggtggcgtgcgcctgtagtcccagctactcgggaggccgaggcaggggaatcgcttgaacccgaaaggcggaggttgcagtgagccgagatcacgccactgcactccagcctgggtgacagagtgagactctgtctcaaaaaaaaaagaaaaaagaaaaaaaggaaattaaggccgggcatggtggctcatgcctgtagttcaaactactcaggaggctgaggcaggagaattgcttgaacccgggaggtagaggttgcagtgagccaagatcgtgccactgcacactcccagcctgggcaacagagagagactccgtctcaaagaaagaaagaaattgcactaattccttaacatcatctaatatccagttcaatgtacacattttcctggttgtttcatgaataactttttacagttggttcgtttgaaccaggatccaaacaagatctgcctgttgtgtttgactgataggtctcttagaactgtaatagtttccgctccctcattgtcccttgctatttatctgttgaaaaacctggcttatttgtcctttagaattcctgttttctacaaggattgagctgggaggggaaaaaaagaatttctcatgttctggctgtggccgaatgtatccatttagtatcattctgtttatctcttggtttctttcttctctatatttcccataaacttatagttggatccgaaggcttaattagacttaggttcattttttttttttgccatagacagtactatattaatctatgctgatgaatgaatgaacttgttttacataacatattgtgtaagtatttccctgtcagtacttaatagagctacgcattccttctctagttgcttaatgatttcctagtatggactaccatgatctacttaatccttaccaacataggttgtttccagtttttagtttttaacaatgcaataaatctatcaaattcctggggaagacaaaagcagattaataaactgagatagaaaaaataagctagtagtttacatgtttaagaatttttggttgtatattaaaagatcaagtgaatagtcactggcctctaaaatatttagaaatctccaattgtgccgggcacggtggctcatacctgtaatcccagcactttgggaggctgaggcgggtgaatcacctcaggtcaggagttcgagaccagcctgcccaacatggtgaaaccacatctctactaaaaatacaaaaaattagccgggcgtggtggcgcctgcctgtaatcccagctactcaggaggctgaggcaggagaattgcttgaacccgggagatggaggttgcggtgaaccgagaggacgccactgtactccagcctgggcaacaagagtgaaactccgtctcaaaaaaaaaaaaaaatctctaattgctgagtatattcattacaaattatgaaaaaaagccaggcgtggtggctcacggctgtaatcccagcactttgggaagctgaggcaagcagatcactttaggtcaggagttcgagaccagcctggccaacatggtgaaaccctgtctctaccaaaaatataaaaaattagctgggtgtggtggcgggcacctgtaatcccagctacttgggaggctgaggcagaattgcttgaacctgggaggcagaggttacagtgagccgagatcacgccactgcactccagcttgggtgacagagcaagactccatctcaaaaaaaaaaaaaatatgaaaaaagcaatctggagaagactcagtttgtctttgacatgtctttgactatatgtgtattttattccagaaaagtatgatgggggtgatgcgaggaaaattacacatcaaactgagggtgatgtaatcatgctttccagcagatagatggaaatgtagttgtttaatcttcagatgtgatgtgtactgtgccatttaggcatttgttttttatttattcatccatctagttggttaattacactcagatacacagccaattgaggatctgaatgtagtgtatatgtaatgttgatggaacacaaaatcttttttttttttttttttttgagacagagttttgctctgttgcccaggctggagtgcagtggctcagtcttggttcactgcgtcctctgcctcccgggttcaagcaattctactgcctcagcctcccgattagctgggattacaggcgcccgccaccatgcccggctaattttttgtatttttagtaaagatgggatttcaccatgttagccaggctggtctcgaactcctgaccacagatgatccacctgcctcggcctcctaaagtgctgggattacaggcatgagccaccacactcgacctttctgattcttagtttaactgtctttaaaatgggaataattacagttttctctggctcatgtttcttatggtcatataatggtgatgtaaatattttctatggtttctctatttatttatttattttgagatggagtttcattcttgtcgcccaggctggagtgcaatggcatgatctcagctcactgcagcctctgtctcctaggttcaagtgattctcctgcctcagcctcctgcgtagctgggattacaggcacttgccaccatgcccagccaatctttttgtatttttagtagagacggggtttcaccatgttgggcaggctggtctcgaacttctgacctcaggtgatccacccgcctcggcttcccaaagtgctgggattacaggcatgggccaccgcgcctggcctggtttctctatttaaatctgaagaattttcataatgcaaaattttttctggcacagttacttatgtttttcttttctttcttttagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaaccca

SEQ ID NO: 4433 - DNA, 31706 bp, human
accgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcggtaagcctcctctctggaaatcaaatgtttgtcccttaatacttgtagaagtaactgataatggcaataattatcttattaacaagagtaaacaagcactgatacagcactttgatatgcgcagccctgatctaagttctttattcacattcatctaatctttccaacaacggaagtaggtgggcatgattattattcccaatacatagatgaagaaactgaggcacgtagaagtaatttgtacaagaccacataggaagtgggaagctaggatccaaacccattagtctgcctttgaaacctgtgttctagccaaaacaattgttgcactgtctcataatgaggatgtatttcctatttcattctgtatttctgccctaatcctataaaaagtgtaagccccatccaggcgagcatctggaaaaatttagaatttgtacagtgacgtgccactgccctccagccaaagaccactaggggcacacctgtagttgaagaaattgggtttctcattgctgcaaggagaacgcacacgtaggaacacagtgacatatttcagtaaaagagttagatttattataggatttgggctttggttcggtgattttggggcgagttcaaggaagcaggagctttgctctggatcgggtgttgttaggaagcagtggtaacaccaaggcccagctgtgactgccagccttggtgttagttaagcccagcttagctcccagatgttaagggctgcttttctctttcttaagaggattgtatattccaaggcatccccaaggagaaatactgaatagactcagaaggctctctgcatcagcagtgtaacgtcacacatacataaaaatgtgaaacatattgataaattagggcagaagttcttaattcagggggtatgtgaacttgtatgggggaaaaaatgacaacttcattttcactaacctctaactgaactttgtttctttcaattatagtgtagataacaagccacagtagtattaacattgatgactttgtcatcaatggaaagcacagatattttcatgttacattgcagtcatgtcagggatcttgaaatatttatgctcgttactacaaaaatacagtagttattagagctcatttaatgcattaagaagacacatttactataattttgttttaaaaaatattttgatgatttcaatataattggagcaccttgtaatcctatgtattttatgttatgcgttttaaaaccaattcttagaagagatctgtccataggggtccatggcaccaaaagaaatgataaagagcccctggtttagtaacagagaccaagcagtgagtaagaatttgggagctgcatccaaattggagcattactgcatccaaactcgttgctttaaagaatagaaagttggaggtggaatcagaaatttagtgtataccctctcactttaccaaggagggaactgaaccactgagaggttaagtgacttgcccaaagtctcactgctatttggtgataaaactgggacaaaacgtttttagacaaacatgtaaaaactctccactgtgctaggcactgaggactctgtagttaacaagatgcctcctgccctcaatgagcttgttggtagacagctggagagtgaggagattgaattattgagttaaaaagttaactccaggtgtagtgtggaagatgaataagaggagaaaaagactggagacagaccagttagaaggctatggatagatttacttgtcttttccatataccatataatatttttagtacacaaagaatgtaaactgtaagcaactttaagagatccacaatgccttcctttttaaaggattcagaattagtacaacaatcatatggcacttgagtcttgtccaaacagtgtaatagtataaattatgacctcaaagggttaatttatgtactttcagattacttcattggagggaaaatgaatcgttcctcaaatgtaccacgtaaaggtattctgaaatcaggtacaagatccttacaaaaagttcgcagagtacatttcgcaaatgcacgaaatgcaagatcattactatcgtaagtacctgtgttttgccttgtgttatcttccacaactgtacagtttccaaacagtacttattcagataacttcaaatgcttcttgttttgtaaatcaaagtttttgtgttttaaaattactttcaaattgagtaattataattgcattttctaatttacaaagcatattaacacacatctacttgatcctgatacaaccttgtgaaacaatttttacattttataaatgaagtagtagcaaccgggagaaggtaagtggcttgcagaaagttatcagctaataaatggcatcagataggattcaaaggtttgtttccacacttcaggctttttcctttctttttttttttttttttttttttcagacagagtctcactctgccacccaggctggagtgcagtggtgcgatctcggctcactgcaacctctgtctcctgggttcaagcgattctcctgcctcagccttccgagtagctgggattacaggcatgcaccaccacgcctggctaatttttatattttcagtagagacggggtttcaccatattggccaggctggtctcgatctcctggcctcaggtgatcccacccgcctcggcctcccaaactgctggaattacaggcgtgagtcactgtgtctggcctagccttttcttctttatatcttgtagcctgcattttgccagccaatgggtagcattatgcaggagtacctgtctttgtacatagcgctgtaaggggtaatgatggggtgagaaggtatgaaggaggagacccctacaatctgccagtgctgggatatgatcaaaagtagaataattccgacttgacctggatgagcctggttcaagcaaagatcagagaaggaagtttctttttctagggcatagtcatccacccccagaagagaactgggcctcctgtaactttgactattccccattccattttcatagcacttgaactagttggacgtttcattttaggtcgtgaatgtttttgggaagtaagcttgtctcctcatactttttatttataatatacatgcctcttaatgatatatttatattttatatgccttttgatgacaaagttttggccaggacttttttttttaatctcaagggaaatctcctcaagtatttcatatcctcattctgagtagattctgcaaatgaccacttccaattaccacatccaaatgttcctcattaggtcagtcttagagtgggggatggggaggtacaggaggaggaagcataaattgatagttctctaaggttttaggaaaatgaaaactactttataaatattaacctctttttttctctcagaatgcttaaagacatttcagctcaaataatacagagggcttggttatctcatacaaacaaaatgatatttcgactcctaaaacacgcaatttgtgcagcggtatgtattttgcttatttttttctctgagggatttaattatcaagctaaaagatctattaattaaagatcgaatagataaccttctttatctcctcttttttttttttttttgagagggagtctggctctttcacccaggctggagtgcagtggcacaatcttggctcactgcaacctctgcctcccaggttcaagcgattcttctgcttcagcctcccaagtagctgggactacaggcacctgtcaccatgcctggctaatgttttgtatttttagtagcgatggggtttcaccatgttagccaggatgatctcgatctcctgacctcgtgatctgcctgccttggcctcccaaagtgctgggattacaggcgtgagccaccacgcccggccctttctttatctcttctatttggatctaataatatcacgtggagttctggaattgtttcttctgttagccctagatgagtatttctggattttttaaaatgtggatgactattacttttttctgaaattaatatactgcttgccttgttttgtttttaaatttgattccttatttgaaaatgtgagacagttctcttccaacaataaaaagctccgaatctgcaaggtgcagcatctcacgcctgtaatcccagcactttgggaggccaaggcagggagggccaggagttcgagaccagtttggccaacattgagaaaccctgtctctactaaaatacaaaaaaatagccaggcgtggtggcatgagcctgtagtcacagctacttgggaggctgaggcaggagaattgcttgaacccaggaggtggaggttatggtgagcggagattgcgccactacattccagcctgggcgacagtgagactctgtcccccttcaaaaagctctgaattaaaagttcccttaccttttatccagcaattttacttctaagaatctgttctacaatacatacacaatttgattgcaccgttgtttgtaacagcaaagggagtaaactgtataatatctattgatatgatgctggttaaataagtgttgctgcttttatagtgttaaactttgcagctttaacatgattctgcaatagaaaggaaatgaagatagctcatcagttaaaaaagcaagcaccagacagtatgaagagcatgatcctacttgagtgaaaaccaaaaccaaaaaaaaaaggtgcatatcccccctcctccagaaagcaactctggcaaccctagcagagccttccttggcatagtaccaaatattctaataaaacaacctataaatccagtagtctattattagtgatactcttttttttcttttcttttttgagatgaagtctcactctgttgcccaggctggagtgcagtggcatgatcttggctcactgcaacctccaccacccaggttcaagtgattatcctgcctccgcctccctagtagctgggactacaggtgcgtgccgccatgcccagctaatttttttttttttgtacttttagtagagacagggtttcaccatgttagccaggctggtctcaaactcctgacctcaggtgatccaccctccttggcctcccaaagtgctgggattacaggcgtgagccaccacacccggccaattagtgatactcttaagggaattttagcagctctgaaaaaaataataaagtctgagcaatgtatacaccgttcaccatctgacccacagacctatttctgatgtcagtaaaagcagaatacggctgggcacagtggctcacacctgtaatcccagcgtgagctgggatctttaggaggccgaggcgggtggattgcctgaggtcaggagttcgagaccagtccggtcaacatggtgaaaccccgtctctactaaaaatacaaaaaaattagccgggcatggtggtgtgcgcctgtaatcccagctaccttgaaccggggaggtggaggttatagtgagccgagtttgagccactgcactccagcctgggcgacagagcaagactccgtctgaatacttcagagaaaacccacccaggtaaactcctggcatttcaggtctattatccattgtctttgaatatggaacttgtatttaattttataatgctggtttcatagtatttttagacttttgtaacagaaggaaattcttttttatctgttatagtaatactttaataccttaaattaataatgctttgtccttttaaaagctatttatttatttattttgagacagagtcttgctctgtcacccaggctggagtgcagtggcacgatctcggctcactgcaacctctgcctcccgggttcaagcgattctcctgcttcagcctcccaaatagcttggactacaggcgcctgccatcacgcctggctaatttttgtatttttagtagagatggggtttcaccatgttgaccaggttggtctcgaactcttgacctcaggtgatcctcccgctttggcctcccaaagtgccaggattataggcgtgagccgcagtgcccagcctaaaagctctttagtgtacatttttatgtgattatcataggcataacggggttggttggggttgtttgggggaaagagttgggactttagagtcaaacagaactaaatgaatcctggcttccccattcactacctgtatgcctttttataaattacaaaaattccctgagcctcagccttctcatctgtaaaataggcgtgataatattctcataatgggccaggtgcagtggctcacgcctgtaatcccagcactttgggaggctgaggcgggtggatcacctgaagtcgggagctcgagaccagcctgaccaacatgaagaaaccccatctctattaaaaatacaaaattagccaggcatggtggcgcatgcctgtaattccagctactcaggaggctgagcaggagaatcacttgaacctgggaggtggaggttgcggtgagccgagatcatgccattgcactgcagcctgagtggtggctcacacctgtaatcccagcactttgggaggctgaggcgtgcggctcacaaggtcaggagttccaggccagcctggccaatatggtgaaaccccgtctctactgaaaaaatacaaaattagccgggcgtggtggcaggtgcctgtagtcccagctactcgggaggctgaggcaggagaatcgcttgaacctgggaggcggaggttgcagtgagccgagatcatgccaccgcactcgagcctgggcgacggagcgagactctgtctcaaaacaaacaaaaaattctcatagtgttgctgatgtaaggattaaatgagctaatgtatataaggcacctaacatagtagtatatggtacataaaaggtgcttaaaagctagtaacttattactattatcatcctcatcttacagtgattcattcaacaaatacttcttaagcatctgctgtgttccaggcactgtattagatgctaggaatatagtggtaaagagaaaagccaccatccctaccttcatgaagcttacagtctagtaggaggcacagacaagttgataagtaattataatatattgtgaaaagtgctgtcatagggaaataatagtgcctttgatctctaaaagggacagataaccaaagttggaggccaaaatgattaagtaactggctcaaggctacacagatagtaagtggaggtgccaaaacaaaaacccaccccttcagaactccaagtccagcataatgttcactttaccacgttgcctctgttatagtccataaattgtgtctgggtgggatactgctttccttttacagcactgtcctttatttcaggaattctatgtaacacatgaaatactgaagaaagtggcccccttagaggctaagcttattaaggatcctactatgcagtgtaaaattagattcaggtaatgtatctatgctgatttatttcaagaagtacttagttaatatgaggaaatcttagatatggattttttaaattcttgtaacttctcagaacttaattacaaagtaaatgtgttattcttatttacatttgttatgtgaagaaaccgaggcatgactctgtggctaaaagttgccatgagagtagctctcatctcccattctgtattcagtcttacacaggtatgagaatagttgtgagtacaccaaagtgtgggtcttacatcctatgtgatccatttcattaccaattctttacatgctctgacatagcctttaccctgtatgcaagaaactatatgaactatcttaagtataagggggaaaagcaactgagcccaaaacctgatgccaaataactaaatttttatctttatttcagatttagaggtgaaacgtttccacctttcatcgtgtttaaaatttttcttcatactgatggccatggttacaagtattttagtggaaaaaatgtattaatgccgtcaagtaaggtgacgtttcatgatgtacattttatgttaacttagctttttaacatctacatagtatctgaattgcattcaaattatacagaataagttatttcaccatgaaacagcccaccaggtaggtagtgtgtttttttttaagcaccatgtttcaaagtgtctccacttactagctaaaaaaaaaaaaaaaaaagacatttggagtgaattacttaattaaggctctagaaaatatccatccatttttatgtattaaaatttttatttgttaataatagactaggccaggcgcagtgactcatgcctgtaatgccagcactttgggaggccgaggcgggcagatcacctgaggtcaagagtttgagaccagcctggccaacatggtgaaaccccatctctactaaagatataaaaattagccaggtatggtggcacatgcctgtaatcccagctgctcgggaggttgaggcaggagaatcacttgaacccaggaggtggaggctgcagtgagccaagatcgtaccactgcactccagcctgggcgacacagtgagactctgtctcaaaaaaaaaaaaaagactaaaattggtcagggctcttaaattatgcagaacatttaatttaatgccattttatttgttttaatggaatgttattatttctttgattctggtagcacatttagaaaaaaaatggtctggactatgctattgaaaatgaactttcagccaggcacggtggctcatgcctgtaatcccagcactttgggaggccaaggcgggcgaatcacctgaggtcaggagttcaagaccagcctggccaacatggtgaaaccccgtctctactaaaaatacaaaaattagccaagcgtagtggtgcatgcctgtaatcccagatactcaggaggctgaggcaggagaattgcttgaaccctggaggcagaggttgtggggagctgagatcgcaccactgcaccccagcctgggcaacagagtgagattctatctcaaaaaaaaaaaaaaaaagaaagaaagaaaatgaactttcaaatatttatccttttttcacatgaattctcatcatacttatttatttctttatttattttgagacagagttttgctcttgttgcccaggctggagtgcaatggtgcgatctcagctcaccacaacctccacctgccaggctcaagtgattctcctgcctcagcctcccaggtagctgggattacaggcatgcaccaccacacctggccaatttttgtatttttagtagagacggggtttcaacatgttggccaggctggtctcgaactcctgacctcaggtgattcgcccgcctcggcatcccaaagtgctgggattacaggcgtgagccaccacacctggcactctcatcatacttttaagtttcatgaatattcaccacaaattgtgtctacagtataggaatcacctgggaatcttgttaaaatgctgccgctgctgctggtccataaaccacactttattttattttattttatttttttgagacggagtctcgctctgtcgcccaggctggagtgcagtggcatgatcttggctcactacaagctccgcctcccaggttcacgccattctcctgcctcaacctcccgagtagctgggactacaggctcccgccaccacgcccggctaattttttttgtatttttagtagagatggggtttcaccatgttagccaggatggtctcaatctcctgacctcgaaaccacactttttttaaaattcattcagccactctatatcttttgattggagagtttagtccatttacatgaatgttattactgagaagtacagacttagttttgccattttcatatttgttctggttgttttgtggtcttctcttccttctttccttccttcctgccttccttttagtgaaggtgattttctctggtggtatgttttaatttcttgctttttattttttgtgtatctgttgtatgttttgggatttgaggttaccatgaggcttgcaaacaatatcttataacccattattttaaactggtgacagattaacacagattgcttcaacaaacaaaaaaataacaaacaagcaaagagaaaccaaataaaaactctgcactttaacttcatctccccactttttaactttttgttttttctattaatatcttattgtattgtctatgtcttgaaaagttattgtagttattatttttgatcagttcatcttctagtctttctattcaacatatgagtagtttacacaccacaattgcaatgttataatactgtttttctgtgtacttactattaccagtgaattttgtactctcagatttcttattgtttattaatgaccttttctttcagattgaagaattccctttagcatttcttgtaggacaagtctgttattgacaaaattcctaagcttttgtctgagaaagtctttatttctccttcatgtttgaaggatatttccactgcatatactattctaggataaaagtttttatttttccttcagcactttaaatatgttacatcactctctcagcctgtaaggcttccaatgagaagtctgctgccagacgtattggaactcctttgtatgttgtttgtttcttttctcttgctgattttaggattctttctttatccttgacctttgggagtttgattattaaatgccttgaggtagtctttgggttaaatctgcttggtgttctgtaaccttctttacttggatattgatatctttctctgaatttgggaagttctctgctgttatccctttgaataaactttctaccctgatctatctctctacctcctttttagggccaataattcttagattcacccttttgaggctattttctagatcttgtaggcatgagtcattcttttttatttgttttcttttgtctgctctaattgtgtattttcaaatagcctatcttcaagttcactaattcttctgcatgatcagttcctctgttaggagactctgatgcattcttcagtgtgtccattgcatttttcagctccagaatttctttctgctcgattatttttaattatttcattctctttgttaaatttatctgataggtttctgaattccttctctgtgttatcttgaattttgttgagctttctcaaaacagctattttgtttgttttttgtttttttacgtcagaacatgaacacaaaaacagctattttgaattctctatctgaaaggttacatacctctgtctctctaggattgatcactggtgccttatttagtttctttggtgaggtcatgttttcctgaatggtcctgatgcttatggatgtttgccaatgtctgggcatcgaagagttaggtatcgtagtatttactgtagtctttacagtctgcgcttgtttgtaacctgtccttcgtgaaaaggctttccaagtattcaaagggactcaggtgtcgtgatctaaatctttggtcactgcagccatatctgcattagggggcaccccaagcccagtaacactgtggctcttgcagacttgtagaagtactgccttgttgttcttggctaagatccggaagaattccctggattaccaggcagagacttttgttctctttccctacttttcccccaataaatggaatctctctctttctgtactgagcagcctggagctgggggacgggtaaaacaagcacccttgtggccaccaccaccactgggactgcactgggtcggacctgaagcaagcatagcactgggtctctcccaaggcccacagtgaccactgcctggctaccatttactcaaggcccaagggctctacagtcagcaggtggcaaatccggataggcttgtgatgtaaaccacacttttaatagcaaggctctacagtacaggttttactccttggacccttatacatgactatatttaagttttaaaaagatggacattctcatatttggccatttataaaccacatatcaaaggttatttttctgtaaccctggcaagatcccccttctggaaatgtacacaaaaactgtggcccatcttaaatcatgagttctagcatgtatgcaggagagaagaccacacagcctggcagtttctgatcagatcctgcatgtgcggcattgactctgaagagttttagaaaaggaaaagggaccacttttctccatgttctcaggtagtatcagagaaaatttaactttatttcagaaaattatcaaatgaagccaggctcggtggctcatgcctgtaatcccagcactttgggaggccgaggcgggaggataacctgaggtcaggagttcgagaccagcctggccaacatggtgaaaccccgtttctacctaaaatacaaaattagccgggtgtggtggtgggcgcctgtaatcccagttacttgggaggctgaggcaagagaatcgcttgaacccaggaggcagaggttgcagtgagctgagattgcaccattgcactccagcctgggcaacaagagcaaaactccgtccaaaaaaaaaaaaaaaacacctagaaaatgagctacatgttttcattatggaatatggtgtttcaagaacattaatatttatatagatcaacttcaaatgtggaagtatatgtttatcctacttgaaggataaatttatgccacatttatgtatagaataagcttgtagttacccctataaaatatcatcaattgtttctttcctaggattatataatgaggctttttcaagaactgaaatcctcctgggtctactcctgccacccccttgctgtacacaggcttgagcaaatgagaaccttagaggcagtgattggaaatcactgcttatgcattaaaacccatcataatgctgtataataacttaaatttttgtttaaattagcccacagatagaaaaatatgcctccgtgcctttatcttctgtgctacaactttcactctcctggggtagtcattgttaatggtttgctgtgtatccttcatgtttcccatgaaaatacacacatagagatttttaaattttgttcttattataaaagtgtggtcatattattgaccttgaatttttcactaaacatcataacgggttttaaatgatcagaacatacccaacttgaacagtttaaggttcctttttccctttagttcagcttcaaactctggtaacacttggattcatggttgatagaaaacttgtaaatatggaatatttctcactctaagcttactcaactctgttgctctttgtctctttgtgttttttgtttgtttttgttttttgtgtttttgttttttgttgttgttgttgttgttttttagacaaggtcttaatctgttgccaaagctggagtgcagtggcaccatctcgcaatcttggctcactgcaacctccccctcccaggctcaagcaattctcatgtcttagccagctgagtagctgggattacagacatgtgccaccatgcctggctaatttttgcatttttttttagtagaaaggaggttttgctatgttggccaggctgatctcgaactcctggcctcaagcgatctgcccacttccgcctcccaaagtgctgagcctactgagcactttctatcaaatatgatcttaaacattttatgcacattactctatttaattatcataaacactacagtgtattttctgttattatcctcattttaaaaaagactgagggccgggtgctgtggctcacgcttgtaatcctaacactttgggaggccgaggcaggcggatcacttgaggtcaggagtttgagaccagcctggccaacatggtgaaacccatctctactaaaaatacaaatattagccaagcgcggtggcacgtgcctgtaatcccagctactcgggaggctaaggcaggaggatcgcttgaacccaggaggcggaggttgcagtgagccgagattgcaccactgcactccagcctgagtgacagagtgagagtctgtctcaaaaaaacaaaaacaaaaacaaacaaacaaaaaagactaacttgcctaaggtctcacacctggaaaatgaaggaaccgagatcaagacctagtagcctgcctccaaagtcccagttcttaaccactcctgagagttaggaactatgctaaacagcagcatacacattctcttagatggccctgcaataactctggttagggacacattattcccattttccctattaggaagctagaagttggaaagacttgccaggagcataactgagacttgaacacttctctgtgtttccactgtactatgtacattttgaggttaaaacaaccatgcagttatggtggttttgtttattctgaacctgtatgtaattggactgttccaaaccaagaaactgttccaatgcatggataccagttattacctcttccatgagtgacagttcccagtagaaacaggaaagtgtcttgagatactagagtagctttacaagcccaagtgtggatctaggccagcaaatagccacagagctgtgggggcttctggccacagagatgctgagtatcaggataagtgccagatttagagatggcccgctttgacgctttgagtcacccactaagaacagaacctgcctcttgaatcctaccctgattggctggtatcctggaatctttgcctagtttttgcccttgcttttctcctggctctaggctcttctttcccattgcttcctatggagaaggactttcttgactttggccatacactgcagatgtctgagaaagaacatcttggccattggacagcaaacatttctcaaacccctctcacaggtgggcagagagcttgccctatgctgccaggcatgtttttctttggctgagggaccagaatgggccagacacagatgaggcacacaactgaggcactgcacacataaggaaactgggtcttggagagattggtggtggtggctgagtggggcagtgtagggaggacctgtcaataaatacctttttggggaggctaaggtgggcggatcacttgaggtcatttcaggaccagtgtggccaaaatggcgaaattgtctctactaaaaatacaaaaaaaaaaaattagccaggcatggtggcacgcacctgtagtcccagctactcaggaggctgaggcaggagaattgcttgaacccgggaggcagaggttacagtgagtcaagatggcaccactgcactccagcctgggcgatagagggagactctgtctcagaaaaaaaaaaaaaaaccctaaataaataccttttgtactgtggctcacgcctgtaatcccagcactttgggaggccaaggcaggcagatcacctgaggtcaggagtttgagaccagcctggccaacatggtgaaaccccatctctactgaaaatacagaaattagctgggcgtaaccccaacactttgggaggccgaggcaggtggaacagaagatcaggagttcgagaccagcctggccaacatagtgaaaccccgtctctattgaaaacaaaaattagctgggcatggtggtgcacgcctgtagtcccagctactcaggaggctgaggcaggagaatcgctcgaatccagaaggcggaggttgccgtctgccgaaatggcacctctgcactccagcctgggtgacagagcaagactccgtctcaaaaaataaaaataaaaattttaaaaacccttttttagtaacttcagctaaagtaaattatagttatgcctacagaaattcctaaagcagaaattatatggtcttcatacctgttcagtgtacaattacttgtttttacctttagtgtcactgtggggctggttaattagaaccataaaatgttggaaattaattgcaagaaaacataatggagagatttgccaatactatctttattttatttatttatttatttatttatttatttatttatgaggtggagtctcactctgtcgcccaggctggagtgcagtggcacaatctcggctcagtgcaacctccacctcctgggttcaagcgattctcctgcctcagcctcccaagtagctgggattacaggtgctcaccaccctgcctagctaatttttgtgttttttagtagagacggggtttcaccatgttggccaggctggaatcgaacccctgacctcaggtgatccacctgctttggcctcccagagtgctgggattacaggtgtgagctactacacccggcctatcttttctttagttgtgtaatgtataaagaaatttgttgtggggatgagggaggggggagggatagcattaggagatatacctaatgttaaatgacgagttgatgggtgcagcacaccaacatggcacatgtatacatatgtaactaacctgcacattatgcacatgtaccctaaaacttaaagtgtaataataaaaaaagggaaatatttatggttatggaaatgcttgccctgataaaaatcctacatattgtttttttaaattcacattttatgcttatacaatctctagagctcttactatgttgctataagacagtaatatagtgataatttaccaactttattgaaaatgttgttacatcaataaaatagcatgctggaaaaaaaagaagaaattaatgaaatataaagcaaaaatgatctacctaaaggaaagctccatatcacattttcactaaactgtttgtctcttcagttctatacgttaggaataaaacttcaaccattcaaccatttgaatgttttcttcctttttcattttctacatgtgtctgtgatattctaagctttggaatttaaaaaaataaataaaggaatagtctgaataacaaaagtgagaattggaatagaaaatgcattatagcttgctgttgtgtgttaagaaaaaagaacagtgattctcagttttgatcctgtctcaaccactctttcttttctctttttttttttttttttttgagacagcatctcactctgtcacccagactggagtgcagtggcatgatctcagctcactgcaacctccacctctcaggttcaagcatttctcctgcctcagcctcccgagtagctgggtttacaggcacatgccaccatgctaggcaaatttttgtatttttagtagaaaaagggttttgccatgtttgccaggctgatctcgaactcctgacctcaggcgatccgcctgcctcggccttccaaagtgctgagattacaggtgtgaaccaccgtgcctggcctcaaccactcttttaggccttgtatcaacattataacagagttcccatactttcacaaataccgcattctgacatacaaaggaagaaagaaacttaactggaatcaaaagatgtttgaattttcttttcttttcttttcttttttttttttttttttttgagacagagtcttgctgtgtcccctaggctggagtacagtggcatgatctcggctcactgcaacctccgcctcctgggttcaagcgattctcctgcctcagcctcccgagcagctgacattacaggcacctgccaccacgcctggctaatttttgtatttttagtagagacggggtttcaccatgttggccaggctggtctcgaactcctgacctcaggtgatccacctgcatcggcctcccaaagtgctggaattacaggagtgagccaccacgcccgccctgaattttcttttgtgctatccttcccttcatataaacataccctttgtggccagaagtacagatctgtaatataaatatgtgttagaagagtcagcacatacttatggcgggggtgcagagtacttaagtctctactcacagtctatgtatagctcttagcacaggatacttatatgtggaagggtatggtataagtagggcccaacaggatttgagcttccatatattctgtgattcttctgtctctgacctctcaggtgctttccttgagcataaaatgttgacatttgggagagaaaagaaaacccctctatttgccactttttagctgctgagaatgaagtctgaagggagggaggcttaaacagtctgaaacatacatgtttccacttaccagcagtgtattaacacataaaagagaggtggtactagtgacacctttcattgcagttcctacggtaactcgttgaatcaccagataagttttctctgcattgactgcacgaatgatattacaggtttgttttgcttttcaaaataaaagaattaaaagtcttttaaggggaaaaaccagttgttttaaaactatgttctctgaggattctggactcagcaattcctctagctgcatttaaaaactatgtagatggcctggcgcggtggctcacgcctataatcccgcactttgggaggccgaggtgagcggatcacgaggccaggagatcgagaccatcctggctaacacggcgaaagctggtctctactaaaaatacaaaaaattagccaggtgtggtggcatgcgcctgtagtcccagctactcaggaggctgaggcaggagaatcgcttgaacccaggaggtggaggttgcagtgagctgagatggcgccactgttctccagcctaggtgacagagcaagactccgtttcaaaaaaaaaaacctatgtagataaggctatggaaacaattttaagtggtttaataatccctatataatctctttgcaaatgcagcctttctattgaatagcaagctgctagaagaaaggaacaatatttgatgtatttgtcagaagaaatatgtaaagggcgtgctgatcattaatgctattctactatttttaaagtctattttctattctttttacaggcagtggatgatgcttgcaaactaatgggggaaaggaaatttcaccgtataattatggaagatgaacgtattttcccgaagtccaaagtaactgatataatggatgttgtcaccatgcaagattatgtacaagtaaggaatttagatttagaaaaacaaacaaacccagcaagtcttcctaactctgtcatccaagaagatagaatcatacttttttattatggtaaaatataacacaatataaaatttattattgtattatattttattttatttttcaaatatattctatagaatgaaacttattttcggatgcccaagcactagaactttcttttaaaatttttttttaatttaacttttattttaagttcaggggtacatgtagaggtttgttattgtatataggtaaactcgtgtcaagggggtttgttgttcagattattttgtcacccaagtattaggcctagtatccattagttatgtttcctgatcctctccctcctcccaccttccaccctctggtaagtcccagtgtgtgttgttcccctctatgtgtccatgtgttctcatcataaaattgaccattttaaagtgtacaattcaggggcattaagtacattcacagggttgtgcaagcatcaccaccatctagttccagaaccttttcattaccccgaaaggaaaccctgcatccagtaagcagtcactctccattcctgcatcattccagccccataaaccaccagtctgcattgtctctatggatttgcctaatccggatatttcatataaaggaaatcatgtgatatatggctttttatatgtagggagctaaggaatttgggggttcttttggggtgatggaaatattctgaaatattcataggcagtggtgatagttgcacaacattgtgaatatactaaaaaccattgagttacatactttttttttttttgagacagagtttcgttcttgtcgcccaggctggagtgcaatggcgcaatctcagctcactgcaacctctgcctcttgggttcaagcgattctcctgcctcagcctcccgagtagctgggattacaggcatgtgccaccactcccagctaatttttttgtatttttagtagagacggggtttcaccatattggccaggctggtctcaaactcctgacctcaggtgatctgcccgtctcggcctcccaaagtactgggattacaagcgtgagccaccacgcctggccgatgttgtgttttcacaaatggaaggtttgtggcaaacctgcatcaagcaaatctatcagtgccatttttccaatagcatgtgcttgctttgtgtctctgtgtcacgttttggtcattcttgcaatatttcaaatcttttcattattattatatctgttatggtgaactgtgatcagtgatctttgatgttactattgtaattgttttggagcaccacaaactgagcccatataagatggcaaacttaaccaataaatgtatgtgttctgactgctccaccaaccagccattccattatctctctctttcccctctggtctctctattttctgagacacaacaatattgaaattaggccaattaataatcctacagtggcttctaagtgttcgagtgaaagagtcatgcgcctctcactttaaatcaaaagctagaaatgacgaagcttagtgaggaagtcatgtcaaaagctgagataggccaaaagctagacctttgcaccaaagagttaaacgtgttgtgaatgcaaaggaaaaatttatgaaggaaattaaaagtgctactccagcgaacacacaaatgataagaaagcaaaatagcctcattgctgatatggagaaagtgttagtggtctggatagaaaattaaaccagccactcacgcctgtaatcccagcactttgggaggccgaggtgggcggatcacgaggtcaggagatcgagaccatcctggctaacatggtgaaaccccgtctctactaaaaatacaaaaaattagccgggcatggtggcgggcacctatagtcccagctactagggaggctgaggcgggagaatggcgtgaacccaggaggcggagcttgcagtgagccgaaattgcgccactgcactccagtctgggcaatagagtgagactgtgtctcaaaaaaaaaaaaaaaaagaaaaagaaaaaaaaagaaaaaccagccacaatattcccttaaaccaaagcctaatccagagcaaggccttaactctcttcaattctatgaaggatcagagaggtgagaaagctgcagaagaaactttggaagctagcagaggttggttcgtgaagtttagggaaagaagccgtctttataacataaaagtgcaaggtgaagcagcaagtgctgatggagaagctgcagcaagttatccagaagatctcactaagataattgttgaaggtggctgcactaaacaacagattttcaatgtagacaaaatggccttatactgttagaagatgccctctagggctttcacagctagagaggagaagtcaatgcctggcttcaaaggacaggctgagtctcttgttaggggctaatgcagctggtaactttaacttaaagccagttctcatttaccattctgaaaattttagggcccttaaaaattatgctaaatctatccgggcggagtggctcaggcctgtaatcccagcactttgggagaccaaggcaggtggatcacaaggtcaggagatcgagaccatcctggctaacaccgtgaaaccccgtctctactaaaaaatacaaaaattagccgggcgtggtggtgggcgcctgtagtcccagctacttgggaggctgagccaggagaatggcgtgaacccaggaggcggagcttgcagtgagccgagattgcaccactgcactccagcctgggtgacagggcaagactctgtctcaaaaaaaaaaaaaaaaaaaaagaaaaaagaaatatgtttcataaggctatagctgccatagacaatgattcccctgatggatctgggtaaagtaaaatttaaaaatccagaaacgattcaccattctagatgctattgagaacattcatgagctgggcacagtggctcatggctgtaatcccagtactttgggaggctgagattggaggatctcttgaagatggagtttgagaccagcctgggcaatatagggagaccctgtctctacaaaaattaccccccaccccaaaattagccaggtgtgatggtatgcccctatggtcccagctactcaggagactgaggtgggaggattgctttagccatgattgcactccagcctgggcaacagagtgagaccctgtctcaaaaaaaaaaaaaaaagccacagccaccccagtcttcagcaaccagtaccctgatcagtcagcagtcatccacatcaaggtaagactctctaccagcaaaaagaataggactcactgaaggctcagatgatcattagcattttttagcaataaagtattttttttctttttgtggagatgggatcttgctatgtttcctaggctggtctcgaacttctgggcacaagtgatcctgtcagctcttcctccgtaagttctggcattgcaggcatgagccattatgcccagccataacaaagtatttttaaattaaagtatgtacatttttttttaaataatgctgttgcacacttaaactacagtataatgtaaacataacttttatatgcactgggaaaccaaaaattagcatgactctatttgtgatatccactttattaccatggtctgcaactagacccacaatatctctgagatatgtctgtatacagccttaactattcactcatttgcttcagtgtgaaacatgaaattaatgcagtgccttagagactcccaattatgttttctttcttttagagtcttagactgtgagtttagggaagtgaaccaggaaatgccaactatctttgctaaggacaaagaccacatactttcagattgtgaacatgtcaaggattaatgtcatagagaggagtccccagatagacatactggaagagagagataagatcattgttgacgtttgagtccttatacgggtgtggcactgtctttagcactttacatgtgtgttatcttctttcatcttcaagtttgtaaattctgtgaccttttttacaaatgagaaaaatgaagtttaacaagcctcaaaaaaacttgcctgaggtcacagacagatctgataagtggcagagcagatgattgacagatctatgatatttacccattttactacttcactcaggaaaaaaaatacccagccttactttgcatggcagtgcaggaccataaaaatgaccagcaaattgaaaccatgcaaagcaaacttaataatttgtggggaaaattgtgattgtcctgtgacttttcaaactttttgtctgtagtcccagctacttgggaggctgaggcaagaggatcacttaagcccaggagtttgagggtagcccaggcaacatagtgagaccccatctctgaaaacaaaacaaaacaagcttctttgtcaaaacattaaaaactcttttgctgtctgttataaatacataggaaaatgaaagaaaaaaacccaacacatttagaacacttttagtacactataatttaaaacattagaaacatagacaaagtgtttagtttcttcataaaatatcttaccaactgtgaatatactggaaactattgaattgtacactttaaatggtgaattgtatggtatgtgaacctcaataaagctgtgaaaaaataacttaccaagagtactttaaacagtgcttgccttcttgttcttctagtataacttataagcatcttttctatgtcttgatgtattgtcatattccttttaaaatttggatcagctgccaacattttattctttgcactttaaatgttgcaaaatatctcagagttccttcagtatgaagttttttttggccagcatcacttccactgggaaagcttcatctttttatcatagccactttcctcatttatgttgataagttcatcctcaccaagttcctctagctgtagatctgcaacgtcttgaatgatggcagtgttagcattcccacagtcacctgtttcttctagaactccatgtatgattgattccaatttcacttcaaggggtaccactttttgtttctttgacggggaattccctcttttgattttccatttttgtaaaatgtcacatgggtttatcattgggagacaaaaatgcaacacaactatatacgttgctgtttgtgtgtgaaatgaataacagattcacagtgaccagtcactgattgactttggaaggtatgacatgatttgtcactaatcatgatgatcatctgtcatttatattgtgatctttgagctgaagagctagcaacaggaggccgggcgtggtggctcatgcctgtaatcccagcactttgggaggccaaggtgggtggatcacttgaggtcaggagttcgagaccagcctggccaacatgatgaaaccctgtctctactaaaaatacaaaaattagccgggcctggtggcacacgcctataatcccagctacttgggaggctgaggcaggagaatcgcttgaacccaggaggtggaggttgcagtgagccgagattgcgccgctgcactccagcctgggcgataaagcaagactccatctcaaaaaaaaaagtttgaaaaggccgggtgcagtggctcatgtctgtaatcctaacacttggtgaggcagaggccggaggattgcttgagcccaggagtttgagacctgcctgggcaacacagcgagaccccattctccagaaaaggaaaaaaaaaaagatgaaatggtgcaaaggtaggattgcctgtgtgtgtgtatgtgtgtgagtgtgtatgtgtatatgtgagtgtgaaggtgtgtgttgagagtgtgtatgtgcatctgtgtgtgtgtgtttgaaagcatgaatgtgactgtgtaatataccctaaaggccttcttgttattctgtttcctagcactgtagctcctcctgccctatccctggctcttaaatgcacgactataatgttaaagtgatgatatatatttgtatttttaattcctaatttgatatcattttaaattggaaaaaaagaaaagtgggatttctacaaatactccaaaggaaaatagtgaaaatctccacttcatactagagatgaactcatatttctaaaaaggtttgtgcaaaagtcctctcaacagcctgggcaacatagtgagaccctatctctacaaagattaaaaaattggccaggcgtgatggctcacgcctgtaatctcagcactttgggaggccgaggtaagtggattacctgaggtcaggagttcaagaccagcttggccaacatggtgaaaccccatctctactaaaaatacaaaaaaaattaaccaggcatggtggcatgcacctgtaatcccagctgaggcaggagaatcgcttgaacccaggaggcggaggttgcagtgagccgagatcgtgtcactgaactgcagcctgggcaacaggagtgaaactccgtcccccccaaaaaaaaaaaaaatagccagacgtggtggcatgtacctgtagtcccagctactcaggaggatcactggagcccaggaggttgaggccgctagccatgatcatgtcactgccctccagcctgggtgacaggatgagaccctgtctcaaaaaaaaaaaagtcctctcaacccaagcatgtcatgaacaagctctactaggtatgcagaacacatagctattatcattaatttttaggcccatctgagtttaacttatctgagttatatttgccataaaaatgttgatgcattaaataaatatttagtgagtatgatactgtgtgcatgataatgtgtagcatagctcctgccttccaataagggagctaagtcatacacagataactaaaacattgagtagtcagagagagatcccaataaaattcagagatgggatcaaagaatgccttttggatgaagtgacatttgagtggaaccatgagaaatgtgtctaaaaacattttagagcacccacaaccaatcaattttttttttgagacagagtcccactctgttgccccggctggagtgcagtggtgcagtcttggctcactgcaactgctgcctcttgggctcaggtgatcctcctgcctcagcctcccaagtagctgggactacaggtgtgcgccaccacgcccagctaatttttgtatttttttattattatactttaagttctagggtacatgtgcacaacgtgcaggtttgttacatatgtatacatgtgccgtgttggtgtgctgcacccattaactcgtcatttacattaggtatgtctcctaatgctatcaggtttcaccatgttggccaggctggtctcgaactcccgacctcaagtgacccacctgcctcaggctcccaaagtgctgggcttacaggtgtgagccaccgcacctggccaactaatcagtcttaattgttttttttctctttttcttttcttttctttttttttctctttgagatggagtcactctgtcacccaggctggagtgcagtggcgcgatcttggctcaccgcaacctccgcctcccgagttcaagcaattctcctgcctgagcctcccgagtagctggaaccacaggcacaagccaccacgcctggctaatttttgtatttttagtagagatgggttttcaccatgttggccaggctggtctacgaactcctgacctcaggtgatccacccgcatcagcctcccaaagttctgggattataggtatgagccaccgcacctggccaacttaatcgttcttgttttttccctacagtatcgcagttttttcgatgaggcccctgcattttctggcggcagaaataacagctggcgcaaattaaatcttgaaaatattcccaggacaatgctaatgtatgacatagttcattattcagagtctggagtgatctcaaaccgtctacgaaatgaaatgaagtttctgttacagagaccagtaacgcaagagatccataagcaccagctacggattgtttctgaaattaggtaaaacagattcttcactggggttacaatactaggggcatatctgaaaatgttcacattctgccagatagctcactaaagataagaggatatatggggaaaatagggttggggcagattgctcaaaacgtatgcaattttgtaaacagagcactaacaaaaaggacaattggtacttggggagttaacttgtaccaccagacaggcagctcagtgtagctggaggctgccacagaaaatataaaaaaatgaacaaccatagagtggagatgctggcaactctttcattagagcagttagtgggcatggagacagtgcacatggaagtgggaccccaggccagcgtagttgccttttttttttttgagacggagtctcactctgttgcccaggctggagtgcaatggcgcaatctaggctcactgcaacctctgcctcccgggttcaagcgattctcctgcctcagcctcctgagtagctgggattacaggtgcccaccaccatgcccggctaatttttgtatttttagtagagaatgagtttcaccatattggccaggctggtctcaaactcctgaccttgtgatccggccacctcagcctcccaaagtgctgggattacaagtgtgagccaccatgcccggccgcatggttgccttttaagtggacatgagaggcagtgcgatctgccgagaaccaggagccatccaaggctggagtgggggtaggggaggagtagggtggagggcagtgagggtgagttgggggtggggtgtgcctctctgggaagacagcacttgatgcaggtgctcatttttgttttcatgaatacagtcaaaagggctccccttgcccatgcagcacagaactgagggctttttccttttttgctgaaggttataattctattcttgctactctggctccccttgcctgagataaattgcatataaattagagtgacgtcattcccctttttaccaatagtatgtgagccagttcacattgtagaaatggatgttgtagcaaaatagatgtattatgatctgaaacaacatggacagaatataacaactccaattatattccttttctctttccattactaagcctcacttagcccatcttatttacaaattaagctgctttcttaaaagaagaaagagataataatatgtaagaggacctactggtaatctattttcacactcttataattgaaatgaaaaatactccctttgtacatgaagaagacactgatgacccactgtcaagcaaacatgctggggattttttttcaggagtagagatgagtgattctgacccaataacataatttaacccatatattttatgatcaaggctatacatttgccagacagatggcctggtttagggcacagtctgtcatgaaatagattttctctaactcatccatatgagcactgaatatagaatttaaccctattaccaccaaggtcaaataaatgatgtaattttctctgccaccatatataatcctgatctccctgctatttggatttatcctactgagtatccaagaataagtaatttaagagccaaataattagccaaattattaatcaattgaagagaaaaaatactttcataaagccatctttgaatgcagttgtagtttagcatctcccagaagcaaaccctgagacagagatttaggaggtgatcccaggaacaactgaagggagagggtaaaaaagtggaaggcagccaaaacagtgtgtgttagcaagcaagttaccactgtgggtaactggagcttaatctcccccgggaatgtcagagtcaatgtagaacatgcaactcagaattatcccacagggggcaggggaattacagtattgatacatcaacacccatcagtcattggttaagggttgcttaggaagggacatattaattctcgggcacttttgacctcccctgcacatgggcttgcttttcttttcttttttttcttttctttttttttttttttgagaccgagtttcactcttgtcacccaggctggagtacaatggcacaatctcggctccccacaacctccaccttcctggttcaagcgattctcctgcctcagccttcctgagtagctgggattacaggcatgtgccaccacgcctggctaattttgtatttttaatagagacagggtttctccatgctggtcaggctggtctcgaactccagacctcaggtgatccacccgccttggcctcccaaagtgctgggattacaggtgtaagccaccgtgctggcaggcttttcttttcaaagaaaattttcaaactgagtgatgcagatgctggcattgaaagttgagtctatgttccttataatggtaaggacaaggggattatggacatagcatctgatcccagcactgattaaaaacagcttgtttttccaaccattatgaaatgtaattttttttttttttgagctggagtctcgctctgttgcccaggctggagtgcagtggcacaatcttggctcactgcaaagtccgcctcctgggttcaagcaattctcctgcctcagcctcccgagtagctgggattacaggcacccgccaccacacccagctaatttttgtatttttttttagtagagacggtttcaccatgttggccaggctggtctggaactcctgacctcaggtgatccgcttgcctcggcctcccaaagtgctgagattacgggcatgagccactgcgcctggacgaaatgtaatacttttttgtgttagtatatggtgtaaaaaaataagattcaaatggctactacacagtattttctaggaaagctaattttaaattgataacaggttttataatttttatcatctttgctgtcaatatcatcacctgtacaccttcataagtgccagataaagaactgtgctatgtaaactcaagcagaaatgataactttaacctaaaagcttacatgaaatgctgctccaatgttgctaaggtctgtgatatatttgctagagaaagctttaatgaaatttggaacttgctttgcatttatattttattctgtgtgatttttctgtttttaatacaaacattttctaggggtccatacttaactgtccaacctctatatcggccctacaaacagcaaaatcaagttaaatttctgggtcgtcgatccaagcaagctcaaatgaaagttgaaaaaatgagaaaagtttatttggctaaagaaaaaaatacttctgaggtgactgtaagtttaacttgtactgaattcattgttttggacaatattcaaactgtctgtaaagtagctgtacttacgtaaatgaaattttcctaatctaaagttcaaggctgaaacacatttgacacatttatcataggtagtataaagtgaatttcatcttggtaacattttttaaaaaattcttaatattggtggcaattctgataaaaaccagctgttttggctccatatcagcatgagttggcaaaaaaattattttctctgtatgttgacactgttgattcagcacatctctgatggtggttttttcaaaatggaagtcatttctatctaaacttattaagaactatgctttataaagtctgcctcagtatacttttacatcataggaatttacaacagacatgtattcatgttattactttgtaatttaaaaaatcgctgtgaatattttgagatgaggataaatatagtcaaacattaaaatataaagtagtaaaaaccaaatatataacacttcctacttttattgataattctgcctaggaaccaaaaacgggcccatcaggtacaaaggataactatcatctccactccatcttttgacattgtgaaaactaaggaatctatgtcagagtgtcagctggaaaaagaaaaaaggactcattttcctggtatcaaaacttggcagctggtgattctccatcatgataatgaacagttaattgacagaaaaccaaagttgtttaacaatctgcttgtctgtctataaataatgagtatgtgtaataaaggaaaataacatagaat

SEQ ID NO: 4434 - DNA, 74581 bp, human; identical to SEQ ID NO: 4430

SEQ ID NO: 4435 - DNA, 74576 bp, human; identical to SEQ ID NO: 4431

SEQ ID NO: 4436 - DNA, 74536 bp, human; identical to SEQ ID NO: 4432

SEQ ID NO: 4437 - DNA, 2408 bp, human; identical to SEQ ID NO: 3300

SEQ ID NO: 4438 - DNA, 2453 bp, human; identical to SEQ ID NO: 3301

SEQ ID NO: 4439 - DNA, 2663 bp, human; identical to SEQ ID NO: 3302

SEQ ID NO: 4440 - DNA, 2617 bp, human; identical to SEQ ID NO: 3303

SEQ ID NO: 4441 - DNA, 74381 bp, human; identical to SEQ ID NO: 3304

SEQ ID NO: 4442 - DNA, 69204 bp, human; identical to SEQ ID NO: 3305

SEQ ID NO: 4443 - DNA, 85394 bp, human
agaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactggtaagtaaagacaaaggatggaaatgtatgcgtggctatggcataaaagagttccttatgcgcccgcagccagcgaggaaaacgatgcttagaggattttcatgtaaatgagaagagcgctaccgcctaatccttctcagctgtttatacttagcttctataccgggcgctgctctcagtttacaaagcgttattgtattggctgggtaggaaacgggctgcttgggatatgctgtgtttttgtgcttcgggaggaggggagggcctttttccttttaggtgtgttcttgtctgaaggtaaaaaaatcctacagtgcaattttaaaatggtattctctttaccaagctcgggaagagtcccttgttaagttttaaattctagctaaggaatgcttcgttcctcaactgattttggtgcctaatgccaatttggggggaaaaaaatggaaacatggaagcaaaacttccccatccgtttgaaaatgttcaaaataaataaataaataaatacataggagtccctcaatgatttagttagaaataatacgcatttaaaacgaattgtaaaacatttccagagtgtgctgtgagggtttctcttcaggtagtggaaacctggggagctacatttatttagaaaggggttgcatgcctttaagaatgaaagtgtggaaacggggtactgagagcgtccttccgcctccgtaactgcaccgtaactgctctcccaaatttggtcgtctctctatccctggtcatgatcttttaggtagatgtgaaacttcgttcccaaccacctcagcatgtgtcctcaaggaatcaaaaacacgcatgggtggtgggttttctgtggtccgaagtcttgtggaacttggggagacctctctttgagtcccccaatccaaaagacacactagttaaagctatcctttcctttagcgatttccctcaagttaaaaggtggaatattttgattggctgtggagtttgaccctgggaagagttttttaaaaaaggattttgtgatgtagcattttctgtgaacctgcaaaattagggctcgcagatgagaaggccaacccatcataaaactgttatttcttaataagagttaataagggttcaaaggaggcttagaacaacttcctaaaaagcacaaatacagaggaagttatattagagccctgtgggcttttttcccctatgcttctatttttaaaaatgttttctcttagggcagtttaatagtaactgtgccctagcactttagccacttactgaatgacatacacagtgcagtgtctatgttctcatgagatacaaaccatcccaataagtttgttactaagggattcctttgagtcactaaacaacttatggtttagcataaaggaaaatgaccactaaaagcatattacaagattatcatatgcacatatacatatatacacataaatagagagagagactcactctgttttccaggctggcctcaaacttgaactcctggactcaagtgatcctcctgcctcagcctcccaagtagctgggattacaggcttgtgccacagcactggaccaatatatatatgtgtgtatatatatatatgtatatacacacatatatacatatatacacacatatgtatatatatttgtgcccatgcttacccaaaaatatattttttaaagtaaccacaatcttcaaatttgcatcacataccttcctgacagaggtaaagggcagaggagagaaaggcggcatccagctccagtttgtgcatcatttcagtctcttttgcctactatttttccttccatttttacctcttagctattctgcttcttgattgcttctgcctgagggagatgggcagagaaaattaagggaaagaagaaagttcaagttactttcttgtttttttaagatggagtctcactatgtcctccaggctagagtgcagtggcctgatcttggctcaccacaacctccacctcccaggttcaagcgattctcctgcctcagcctcctgagtagctgggattacaggtgggcagcaccatgcctggctaatatttttttgtatttttggtagagacggggttttgccatgttggccaggctggtctcgaactcctgccctcaggtgatccgcccaccttggcctccaaagtattgggattacaggtgtgacccactgcacctggccaagttactttccactttcactcgtgacagcttattccaggtggtaactcacaagaaccacgcaaagctggcaatgtgctctacaccctcacctcccacccattgtagaaataaggaaactgaggttcagagagggtaagtgacttgcccaagggtcacactgctttgaagggggcagagctgggatttgaacccagagctctacaccggaaaagtggaagatctttcttctataacatactcataagtgagatacattcccttcccatctttttggcagttctggtttcgtgtgtgtgtgtgtgtgtgtgtgtgtgtgtgtgtgtgtgtatcatgcacatgcataggtatgatacagatgtacataagttgaactgttgaagcacctgctttgatttacttatgatacaaaattttccacgttgttcatcattgtcatgggctactgaaatttgactctgtttaaacaggggcttgcaaccaatttataaaacactactaaaattttcaaattgccttctctcttattagctaactttgatcactgtagggttatattctaaatttagatttatactttatagcctaactttcctttgctaatgatcttactttaataactaaggcacatgctaactacttaataaaaaagtttgttgatgaagagagtgagcagcaagtgaaaacatgaaattagcatttctttctctggtttttagtagtttctgttgatcttgtagctttgctagtgtcttcatatttcaaattgtataaattctgcatttctcccagcacccaggcatatagctccaaattgtatgtgggtcactgacaccacagccatcaacagagtgtggctactgagttgcttaactaactatggaaagtgtatgaaatatttgcagggggcctgtttaggattgaagctccacacttggattctccttcagagggcaggctccttctcctagttgctgaaatgaagtggggagctggcatacgtgagtgaataaatagactttaaagcagtctatattttagatccctgtaagtaacaaattgataataatattgcagatatgattgaattatatttcaaggggaagttcttctgccaggaaaacttgtagtttctctacctgccttattcttcattagaggaaaatataagaaaggagacgattaaatagaatgcagtaactctgataaagaaattagaaaagaaataacaaaagcattacctaggttttatgatagagcctatattttaggaatataatcttactactcttaccattttaccatggtgctctgatttgagatgcttctgagaactctttacattgttacaatgtttactcttgattcttgacttgttttcagttctttactattttcctgattaaacatgatgcaaggtgactcatcagcttgactgtcaagatgagaaactgagtggccttgggtgatatgatgtaatagcccttcttggaaatctaactcctgagatacaaggactcctctgagcaaggactgtgtcctcatatcttcccagccctcagattatgcctagaaagatcctctgggctcagcaggtgtcccagaagccctttctaacaaggcccagccaccctgaaagttgtctgcttgagaatttggttaatgaccttggacaagttcttctaggggtgcattctgttgtcagaaggaattgtaattctagactgcaatagtcacttccatgaagatggatatactatggatcaactgagaaggccttggaaataaaaaagggttggttcaacatgccacattagcaggaggagttcatttcgggttttacttcaaagtggagcagtgccaagagactgctgtcttgcagaaggtgcattatgtcagtttggaggtagcatgctcatctgctagtattcaaaaagatgaccagatttccagagacatcaatggcttcctttgctaatattgccatctacttagccacccagaacagcatacattttaaaagtgaaacactcttaatgcgcaatattggcgaaaataaacaaacgtgagcttccttgggtatttactgtggtcaactggaattctgcctaaggttattattaggtatcttcctgctggtctctatccaaatgcaacatccatgtcttgcaaattgatactagtcaggtgtatttagcatggaatcaatcaattagtttcttccattcttttaggtttgttctctcactacccctccaacccaatttgcctaatgctaaacccttatggaagaaataaacctaaatcaaatataataggtagcttctgtgttttattttgatgatttagcatatagaaatcaaaagagtgcatgtatatgtcctcaatcaggcagtgaggaagatttaaagtatttagcaatgcagagttttggaagataactgagagaaaactgagtctcttaccaatccttaccaacccctaccatccccttacccatgggatccacagtcagccaggtggttaacaacttccagacacagcaatgcaccaggtgctgtggagagaaataaaagaagtgaatccaaaccccttgcccctaaaggggcatttccgtttaatagaaggtagtagtttggtttgtggaagcatgccaggatgctgaaatcccttaagagagcttttttgtaagtttgactttaacatattagactttcttaaaagctattttttatccattgaggggaagtacttcccagcagggaggactctgttaacccaatccccaagttaagaaaagtccctgcatttgaagaaaaggttttacttgctcaccccaatacatattttgggacatggaaaggatcaatccatttttgagtggatcttaagcccccattgtgggtcacatactggcctagaactctagaacagctctgcccagtagaaatacagcatgagccacatgtgtaattgaaaattttcaagtggccacagttttaaaggttaaaaaaggtgaaattaattttgtatccaaaatattatgtcagcatgcaatataaaaattattaatgagatcttatattattttcttcatactaagtctgaaatccaatgtgtatattgtgcttgcaatacatctcaattcggactagctaatttcaagtgctcagtgactacatgtggctttacagggagcttagacacttgtccagccctgttaggatcagttctgaggacctacaatgataaatacttttcatgttgcacagttcacgtatacatatatgtagtcataactaaaaccaaacatcacttttccttacttcatgttttgcactcttatactttctatgctatcctatcttattctatttcagttaagagactgttgcagtaatctagatgagagttaataagtttgaaattatagaaggacagtgggaaaggagagaactagatggatatgggaaacactaaagagataaatgccccaagatttgataactaagtctgagcatggggcaggttcagtgaaagatcaaggggccaggcgcagtggcttatgcctgtgatcccagcactttgggaggtgaggcaggtggaccacttgaggtcaggagttcaagaccagcctggccaacctggtgaaaacccatctctactaaaaatacaaaaattagccgggtatggtagtgtgctcctgtaatcccagctacttgggaggctgaggcaggagaatcgcttgaacccgggagacggaggttgcagtgagccgagatcatccctctgcactccagcctgagtgacagagcgagactccatctcaaaaaaacaaaaagatcaaggaaggcacagtttgttttctggctccaactagtgagtgccatcactgagatgggtgtgccagggaagtagagtttgtgagagttatgtctgaggtgccatggggacttccacttggaggtgtctagttcatgtttggttggggaactcaggagagagttctgagctggagatatagatctgggagatagcatggaggagatggaagtgaaattgaggcagtgaaatggatgagagtgaaattgagatagtttctggactgagaaggaagtggatggagatggttacctaggaagagtgcctcaggataatcccactacagggctaattctagaaagtaactgaccctgagccatcctatcaggttcttagagggggaaaatagaggagctgtaattaaagctattagactcctccttctattcatctgtctctacatgaaatctggttaagctaatctactttatcccagaatcttcccaggttggaaccctaagaaagactacttaaagggccaatagaagaaggatcatgaaaagaagacagagaagtatttctcaaataactgggagatcaagggaccaagggcagggtaagtttcatggagggaatgtccaatagaatcaaatgcagtagagagatcaaatgagttaaggaggaaaagtttcctttggatttagaaagaagaggtcagtggtgatgtttcagtgaagtggtgggagcggaggctggatggcagtagattgaggagcctataggtggtagggaagtggaagcttgactgagagaggaagcagatagaatgtacagtacccagaggtggacaaatcagggcttagggttactagagactagcttttccccttccttctttcgttcctttcatcttccctcccttcatctttttttccttttatttctcattcctttcatccatccaagatgtcagatcttttggttggctcattcttttaagatgatagcaacttgtgcctaaatataaatgggaaagagccagtgggagagggaaggggcgatggtgatggggacaactgatgaagggaatgtctcttaggctggacaggttgggctccagtgcacaagtggaaggattggcttcagggagaaaaaaagacacctctcccactgtagtggcaaggaagctggcaaggatggtttgggcaagaacaagttataagaggaagggtactgaaagttgaaggcctctctatctgatagcctgtttttcatctgtgaaggtggaagcaaaatcatggtggcttatttctggctagtacggaactataattctggtatatcctgggtagttgagtccagccccaggatatgtcctctcctgaggcctccaggctgtgggtagggagaagtggaaaggctgagatggttcctgatgagatgcagtgatgagagcaaatggatctgcttcgttgtggcctctgggactccacaccaatgcccatcaagccaagtctagatctggccagggagagctgaactagcccacggtgaaaggacagggggctgtcaagacaaatgtgctaaagcttggtctggacttgctggagcccatagtcttgttccagtgtcagttttgccattgaattattgtgtgcacttaagcaaatcactttcctctctggattccattctgtccccgacaatggattggatagatccttagagtgtgattctagctttcattgccttggaacttggtctactgcagtatgttctgtttgagctcatgctcctatcaaaagtctgggctaccccattcctcaccccctgttggttttatccatttggggtaaaaacaggttgcatgatcttatggtaagacacactggctaaatatgaataacaaatgttcacaagcactttgaagttttacattgatgttgtacaaaccacttctgctgtcttctgttttattcttcagatgctttctcagacaggttgaatgtattccaaatcatatatggaatgttctattcattgtttcgggaaacctgtgttgaatctcttcttaatgtgaacagtagcctcctaatttatctatttcatactacagaagtttgaaacattgggccttctttgaggcatggcagtatgggcttgaactatagaggcctttcttaatcaatgttgtccatctaagcttgctacttggggttaaagtccagcaatgggtcaggctgtagtcccaaaactcttacatctttagctggtgccccacacaaagcttctcagtgactgttagggaaataaatgcaggaaaataattatcccatcagatcactggggggaagaatgaaaaggaaaaaaaagcaaggaaggtagaaacaaactaagtcattgcaagctaggcctattttcttccaataatctcccaggtaacagcctctaccttgctaggatctgattacccgttgctggcctcagaccatagcattattgttttaacattcctaccttcctctttatcccagcatgaactgggttgtatgggaggctgggaagctgaccttgcttggggataaagagacagtttagcactcaacaatcttgaaggcagacttgaaaacacagtgattagaaaataaagcagtgagccctggtagtgtgcgcctgtgtaatagtgtgcagggccacacggggctagcctattgagcagaattcattttcatataatctcctccctcccgccaaaatctttgacttggtgtttttgttttctactcggtaattcatgcatgctgaacctgacatcaggatgctgagggttatttaaactgtcatttaagaaaaataacaacggtaataggttaatagaaacatcatgaatgatgtgtacagcctattgccaaccaaatgatgttgaaagcccattcctggtacatgcaggcttctgtgtttcatctctggtgtgcctaatattgactgtaggcacagtcacataataataaattctattgtacctccaaattgtttagttataaggtaattgttctatatgggatgcaaggctagtggtctcactcctttttctccatgggcaagtcggggaattgaacaaccattcacagtgcacactgtattgggcactgtgttgaatgctctatatgtattatctcatttaatcaggctgcagacccatgaaataagcattactattcctcatgttataagtaaggaaataaataatcaagtaatttcccaaagatccaaaaagatacatatgtatatttttgagatgaagtcttgctctgtcacccaggctgggtgcagtggcatgatctcagctcactgcaacctccgcctcccaggttcaagtgattcttctgcctcagcctccccagtagctgggattacaggtgcacgccaccacgctcagctaatttatatatatatatatatatatttttttttttttagtagagatggggtttcaccatgttggccaggatggtcttgaagtcctgacctcaagtgaccctcccgcctcggcctcccaaagtgctaggattacaggcgtgagccaccgtgcccggccccaaagatcaaatattaactgattaagctgggagttgaaattaggtttgtctgacttctaaagcccctatttccatgacacatagttcacaaacttcagtgagcagagaattgcctgctcaagctcccaggtgattcggaagcaagatgtgcctagatgcacttttagagatgctttatttagccctcccagtcatatctgctgtgtttgggaacaggagtagaaataaatcagatatctgtgttctttgtagtaaaactagaaattcaatgtaaatattttgacccagcagttgcattcctaagaaatttgtacacatggccaccaaaaaaactagtattaggatgttcttagcagtgttattcataataaccccaaactggaaactacccaaatgcccagcagaagcagaatggattaaaaaaattgtagtacactcacacaatttaatgctgggtagcagtgagattgaagaatctacaaccacctgcaggaatatggatgaatctcacaaatgtaacattgaatgaaagaagccagatacaaactaatatgcgccacatgatttcatttctataaaatataaaataaaataggcaaagctcatctttgatgttagaaatcggtgtagtggtaggagcatgggatggacgctggaagtgttaggttacgtgatatgtggctgtgtgtacttagcttgtgaaagtccattgagctgcacttaggatatgtgtacttttcttttctttgagacagagtctcactctcacccaggctggagtgcaatcgtgcaatcttggctcactgcaacctccgcctcccagttacaagcggttcttctgcctcagcctcttgagtagctgggattacaggcatgtgccaccacacccagctaatttttgtatttttagtagagaccaggtttcaccatgttggccagcctggtcttgaactcctgacctcaggtgatccacctgcctcggcctcccaaagtgctgggattagaggcatgagccactgttcctggctgatatgtgtacttctctataagtctattattctttagtgcaaagtttaaagatattattattcacaataatgaagaaagggaacactctacattgtatttcccatttccaaataattctggtgatctaataaactctaaggaaaggcatcacatcctacttacaattatagctcttggctgctaacagagcttcaaagtgctcagcccttccaggggccagtatatccagccccaaagagagtctagtgagcacttgaacgaaacaccttatgtctaggaccagtccagccctagtcaggtaatctgtgaattaaaatccgtggcccccaattgtgtactatgcctggcctcacagtcagacaggttgtgggctgaggaaatggatggcattggttaggtagcaagagtacctcagaataaccctgctacagggtgaattctagaaaatagctgacccagagcctttgcatcagggtttgggaaggggaaaaatagaagagctgtaattaaagcttttagaatcctccttttatctgcctattgctacaggaaatctggttaaattaatctactttaccccacagtcttccaggatggaaccctgagtgacaacatttagagatccaatagacaaagagtcaggaaaagaagacagagagtacttctcaaataggtgggagatcagaggtccaagggtaaagcaatcaccttactggtagttacagttttcttgtaaaatatggtttctgttaaagaaatcatccactttgcagaaaatatcatctttggaacatctttcctttagtgactcagaaaaaaagaggttttattattgaaatagaatctagcaaatacctcaagctgagacatgttagaaatatctgtacttctatccaagtatattgcaaacctcccacactgcataatttgttctaatgcttgtttctttcaatcttcaacaatgttttctatatgtcttctaaatatatttgctgacaaaggaatgcattttagtttgacatcagtttttttttctacacattagagcagctagttttactgtagcatgaagaatagatgattttgcaatggtatgagacttttgttttttctctattgagttatggaaactcaaaaaggcttctaaacatttatcgttacatgtaacagtattttgtgacatgctggattgagtatcacatgactcacaacattgaaacattaaacatggaaaaatcatagaggtttatcttcatgttctggatgcttcattttaaaatatgttaattacaataacttcataccatcattagctaatatctcaaggtgatatttaatgttattggtagcagatatttctaatggtcttctgtgagataattttcaattcagctatcttcttgtcagatcagattgggttgtcgtggttggtacctgataatgtggtggctgcagaacttttacagggagtagaagggtcagctctgccattttcttgttgttcacttgtgtttgcattatctttgctttcctatttcattgcaggaaatgtttttgttgttgttgttgttgtttgtttgtttttgagatggagtctcactctgtccccagcctggagtgcggtggcgtgatcttggctcagtacaacctctgcctcccaggtacaagcgattctcttgcctcagcctcccaagtagctgggactacaggcatgcaccatcatgcctggctaatttttgtatttttagtagagacggggtttcaccatgttggtcaggctggtcttgaactcctgacctcgtgatccgcctgcctcagcctctcaaagtgctgggattataggcgtgagccaccgcgcacggcctgcaggaaatgttttaagccacctgctgatttatgtgcattggtttagttaaaactagataatataatccacaaatacctttatctaggctcaggtgaactgcagtatattgcaataagctgaaagcaaatgaaaaaatgtcaggcgatgcaggccacccaactttcacattccctttaggatacctcatgtatttgatgtggacagaaatggggcaccagtgtaaacccatatatcagaattagaaggccaggcgtcatggctcatgcctgtaattccaacacttcgggacactgaggtggaaagatcacttgagcctaggagttccagaccatcctgggcaacatagtaagacactatctctacaaaatttttttttttaattagatgagcatggtggtatgtgcctgtagtcctaggaggctgacgcaagaggatcgcttgtacttaggagttggagggcgcagtgagtggtgatggtgccaccgcacttcaacttgggtgacagagtgagatcctgtctcaaaacaagcaaacaaaaatagatatttttcttggtttttgtaaagctttttttcttattttttgacatgaaaaataaatacagtaagtcctcacataacattatcaagaggttcttgggaactgtaactttaagcaaaatgatgtggaatgaaaccagttttaacataggctaatttatgtaaacaagagttaagttcgtatggcgtatttctggccacaacaacatcaccaaacttctttttaaaattttttattgatatatatactgagacggagtctcgctctgttgcccaggctggagtgcaatggtgtgatctcggctcactgcaacctccatctcctaggttcaagtgattctctcacctcagcctccggagtagctgggattacaggcgcatgtaacgacgcccggctaatttttgtattttttagtagagacggtgttcaccatgttggccaggctggtgtagaactcctgacctcaagtggcctgccctcctcggcctcccaaagtgctgggattacaggtgtgagccaccgtgcctggcctgattacattatatttgtatatacttaatggggtacatgtgaaattttgttacatgcatagaatgtgtaatgatcaagccagggtatttagggtgtccatcaccttgagtatttatcatttctatgtattgagaacatttcaaatcttgttttctagcttttttttttttttttttttttttgagacatagtcttgccctgttgcccaggctggagtgcagtggtatgatcttggctcagtgcaaactccgcctcccaggttcaagtgattctcttgcctcagcctcctgagtagctgggattacaggcacgtgccaccacacccagctcatttttgtatttttagtagagacccggtttcaccatgttggtcaggctggtctcgaactcctgacctcaggtgatccacccaccttggcctcccaaagtgttgggattacaggcgtgagccaccgtgcccggccacttttcaagctattttgaaatatataatacattgttgttaactataatcatcctactctgctatcaaacattagaatttattccttctatctaactgtatgtttgtacccagtaaccaacctctcttcatccctagccccgctcacccacacacacttcccagccactatctcaatgatagtggtatctatcattccactctctacctccatatgatcaacttgtttagctcccacttatgagtgagaacatgcagtatttgtctttctatacctggcttaagtggctctgaaaagagcctttgctttttgaaagtagaagttgttcacttggagctggtgtacttggtgagggccttggtgttgtgagacacagtgtgattggccatctccctaggcagcaggcacaagctgtatggatctccctggaggtgatcgtcgagtacttgtaatgcatcaggaatgatgcacttgaagatattgacaaatgagttcatgatgcccatggccttcgatgagatgccagagttgagatggacctgcttcaataccttgtaaatgtagatagagtagctttccttgtggctatgcttgtgattcttgccatccttctggctcttggtcacaccaccttcttggcacccttctttggagcaggaacagacttggctgattcaggcatgtcaccacaaatcaataactatactgagaaagaagccacttcaacaccaccacacttctaaataaagaccaaaacactgctagtatcattcaacattgaaatacatgtgagctatgtatacatttaagaaagactaataaaaacaagataattatttgccagcttattccagttcagggtaatgggtgactgggacctatcctggcacctcagggcacctggtgggaaccagacctgaacaggacaccatcccatcgcagggcacactcacacacacaacacattcataacactgggacaattttttttttttttgagacagtcttgctctgtcacccaggctggagtgcagtggtgcaatcccggctcactgcaacctccccctcccgagtagctgggattacaggcatgcgccaccgtgcccagctaatttttgtattttagtagagacagggtttcaccatgttggccaggctggcctcaaactcctgacctcaggtgatccgcccgccttggcctcccaaagtgctggaattacaggcgtgagccactgcgcccagcccacattgggacaatttaaagacactaattaacctgctgtgtacatctttgggatgtgggaggaaaccagagtacccagagaaaacccacacagatatgaggagaatgcgaaaatgcttcacggacagtagccctgacctggaaccaaaatattttttttttctcatccacgttataatgaaaggtcatcgaacaaaatgacattattcaaggatctgaggtataaacacaagtgttgctgtctaatggattgtcttgcccatcccacattagaaaacattggtttaggcattctaaatcttaccattggatccaaccatcagggagaaaaaaactgtattttcagggtgcacgttcgtttggccccttaaagaaaatgcttttctgaaccgctttttggtgctggggttctgccttacatggaaggcactatggagacaaacataaaaaaacaggactttctggctaggcgcggtggctcacgcgtgtaatcccagcactttgggaggccgaggcaggcggatcacgaggtcaggagatcaagaccatcctggccaacatggtgaaaccccgtctctactaaaagtacaaaaaattagccgggcatggtggcgggcacctgtaatcccagctactcaggaggctgaggcaggagaatggcgtgaacccaggaggcagagcttgcagtgagctgagatcgcgccactgcactccagcctgggcaacaatgcaagactccgtctcaaaaacaaacaagcaaacaaacaaaaacaggactttctgtactagggggctgttgttgagtgtatcagtaccgatgttactacagtattacccatcataccctttaaggtggcaccacgggaggaatttctctcagaactcagcatcaggaaaatgctgtgctttttcctcaatagctattttgctttgtgcttaaggacaacattaactttgttttcctctttgctgtgactactgggagcttaaagccatttttgtagtcttacctttttgaaatatagaggactgtgatatgcatttctttgggctcatttcacccctgacctttagaaaacaaacatattttgactgggcgtggtggctcacgcctgtaatcccagcactttgggaggccaaggcgggcggatcacgaggtcaggagatcgagaccatcctgggtgacacggtgaaaccccatctctagcaaaaatacaaaaaattagccgggcgtggtggtgggcacctgtggtcccagctactcgggaggctgaggcaggagaatggcgtgaactcagggggtggaggttgcagtgagctgagatcgcgccactgcactccagcctgggtgacagagcgagactctgtctcaaaacaaaacaaacaaacaaacaaaaaacatcaaaaaacatatttctcctcctcaccccagatcttgcaactattattttaaactttcaaattttatttttaaaatcacctcaagttctttggggaaggaggtggaatatgaatatgatataacattgttattgatgttcactataaacttaaattcaattatctaagaaaaaattatttagaatgtggaatttttatatcttggtaaagattgttttctattgttaatagcatctatgcatttaatgagtctaagaggctattcatggtaagttgcacttccatttcaatggtgttacaatgtgaaaaaatggccaacactgattttaagataatatctattgtaagatccctcctactctcagagatgctaaaatgtggggagaaatgtacattttagaatcaatgaaatgtgactttacttatagtactatgagtcttctagctatttgatattcactcactgctgtgaggttggaaagtggccgcatgagatggagtttggtttataagtggtcagtgttttaaggaagcctgtatctccagggcataataaaaattctgatctctgatcaccaaaagggcagtatgtactaagctgacctagatgtgagcattcaggcactggtttactggtttaaaaaatgaacttattatgtgggaactctaaataaagttggaaaatacgtgttgtttttttttttttttttttttttttttttttgagacagggtctcactctttcacccaggctggagtgcagtggcatgcaatcacagcttactgcaggcttgacctccggggaccaagcaatcctcccacctcagcctccagagtagctgggactacaggcgtacaccaccatgcctagctaatttttcatagagagagggtttcgccatgttgcccaggctgctctcgaactcctgaactcaggcgatctgcctgcctctgcctcccaacgagctgggattacaagcgtgagctactgagcccagcctggaaaatgtgtttttaaaagatatttaagataatttttaaactgtgctcttgttttagttttaaccaacttcaagatacttattctcaacaatagaaaaataggcaaaggacagattattctctgaagaaaatacaaatggccaataaacatttgaaaaatgttcaatctttttgtaatcaaaataatgcaaattgaaacagcatgctaccattttttggtctataaaattgacaaaggtaatactcaatgccagtgagatggcagcaagataggtgctttcatacgttgtaatgtgagtataaatgatacagcttttgtaggaggcaatttaccaatacatgttgaaatgttcttcaaatatttatctttaaaatgttcatacccctgatctaagtaattcagtttctaggcatctgttataaggaaataatcagaggttcagaattatgtttagcatgttatttatattagtaaagtataaataatttaatattcaatgatggagaagtatttaaattacggttctttttcagtgaaatgttttacagctatcaaaattagtgaggttgaaaactatttaagtgacatgataagataatcatgatatattgagtgaaaaaaactgtctatccggcaagattccaaacttgttaatatgtatatatgtcataccagaaagcctaaaatgaaatatagaaggagttaactatagttgtctctgggaagtagaaagaattattggtgacttttattttcctctcttaactttcccaaattttctataatatatattatgatgatgataagaaaaagctatgaaagattgacaaatatatttattttattattgagtttaaagtctgtatttgtctttatcaattatcattctcactcctgtgactttaaattcccccattcagcaaatattcttaaggaccttctatatgccaggtactgccctggggaatagggatatagcaatgagtagacagaccaagtccttgctttcttagagcttccctaatagcagggagagacggagcttaaatatacaatgtttcctcatctgatgacctggacctctcttctacctgcatccatgccctgagctgaatgagtgaatctagtctaatggctttatatatcacatactctctcagtttctaaacctgcatctctagcttagtcctttctcccaaacaccagacttatacatccaactgtctacctgacatctccacttggagatctaataggtgtgtcaaaccaaatctgtgagaatggaattgttaatttccccatccttgttgtccctcccacccctagacctactcttccagtgttttacccctcctagggaatggcaatgccatccttccagttcttcaggccagtagctttggaattatcctgattcctctcattctttcacaccctacatccaatctgtttcaagttttatggatccaaaatctatccagaatctgaccacttcttaccacctccgctgcgatcaccctgacccctgcctctgtcttcttttgcctgattattacaccagacacctcagtggttttcttgtttctacctttgacctcttacagtttattctcaacacattagccagatggtcttgttaaagctaagtcagatcattatcatgccttgttcaaaacgctctgatgcccagcactttggaaggctgaagcaggtagatcacctgaggtcaggcgttcgagaccagcatggcgaaaccctgtctctacttaaaatacaaaaattaggcaggtgtggtggcacacgcctgtagtcccagctagttgggaggctgaggcaggagaatctcttgaacccaggaggcggaggttgtagtgagccgagatcgcgccactgcactccaccctgggcaacagagtgagactccctctcaaaaacgaaacaaaacgaaacgctctgatggctcccatctccctagagtgaaagccagtctttacagtgtcctaaaaagctcacacgactgggtgcctctcatctcctttcttctggtctcacctctggctacatcttttcttttttgctcgcttcctccaagcatactggccttctagttattcctggaagaagccaggcatgttcatgcctcatggccttggcccttactgttttctctgccaggaatgctctttctccacatggctcacttgatcctttatatatttacacatacatcaacttctctgactatcctatttacagtgatacccccaacactccctattccctttccttgccttatttttttctataacacttaatcaccctttaactaaaatactacatgttttatgttcttttttgttgcttgtttattatttttaagtgttatgagggcaaaattttttgttttgttttgttccctgttgtatcctcagaagctagaacagtgcctggcacacagcaaggactcaaaaagtgtttgtctgatgttagaaaaatgaattacgggtagataccatgaaagtaatttaaaaattttttaaagctcaaatgagttttaaatattccatatacctgcaaatcatatcatttaacagttaatttctggataatagtttttatttttcaaaatactcctcttttcttaatatagacctccctcccccatccctgctacatttgggagacctgagccttgattaaattttctgcatctctgaatttaaaggagaggagatatttctttaaatttatttttgcattatgaacattgcatgaatgcattctcattttaaaaataaaacaaaatgacagacatatatggaataaacaatgaaatctcttcatctcttctctcaaaatattatctccttcccaagaggtaaccccaattaacaattcaatgtgtatcattcaagtccagtgctgtccagtagaactttctgtgatgatagaaatgttctatatctgcattgcccagtatagtacccagtagtcacatgggttattgagcacctgaaatgtggctaatgtgaatgacaaactacttttaattttatttaattttaattaattataatttgaatttaaatagccccatgtgactaatggctaccatattagcacagttctaaactatttctttttcttttcttttttctgtttttttgagacagagtttcactcttgtcacccaggctggagtgcagtggcgtgatctcagctcactgcaacctccgcctcccaagttcaagcaattctcctgcctcagccttccaagtagctgggattacaggtgtgtgccatcagacccggctaatttttgtatttttagtagaaatagggtttcaccatgttggccaggctggtcttgaactcctgacctcaggcgatccacctgccttggcctcccaaagtgctgggattacaggcatgagccaccgcgcctgtccctaaactatttctacacaattacctctctcttttcttctttttctctctcttcccccttctctctctttttactataaatgacatcatactagatagcatgtatacatacatattatacatattgctttgtgacttgctttttgcattcaacaaaatgtcttagatataattccctgtcagtacatacgtatctgtcttgctgttttcaatggtgcctgttacttataacatgtacattccatacataactaaatgaaaaaaatggatatttcttggtgctgaaccacatactgggcctcttttttcttctctccagtgacatttattggtgatgactttgcaccagctgcctgatttaagagtctacataatcagtgacacagtctaagaatccagtgattcgtgtgtgttgggcccatggttaactatattatctatttttttctgtcctctctatcttcaaaagacaaaatattctgactccacaataaataaggttttaaaaatatgttcagaaacaagtaaatataaacctaacagtatgaggctgctggattagattttgtgatgtctttttgtaattctgaatttgtggttctaaagctgatgagtttcacagcaaaaggcctacctggaagaagtagattctttctgaagtcctgttcttatctttttttgcatatcctgattaaaatgttctgtctttgtaaaattcttttctaccagagacattcttgagatggttataactttagttactctgggtaattcacttttcaattgatttctatgcttctaacatacctcatcagcattttctagctaatgtttgagcctgacaaactgttatagacacggtattaaccaaggctctgtcaagacacagatggctcactctaaaggtgaaattgaaagagagtttaataaaggtaatacttacaaaggtatgggcagggtttaaggaaacctcaaggaatagtatagtatccttggcctagaaacaatgggggattgccatcccccaggctggtaggggcaaggggtgagtgtggttaccagaacctcacacagacagctctataaagaggaccccctcacagaagctgtgaattttggtaaaaggacagaaccaacacactgcttcctagcagagaggaagccagggagacaaataccctgagctcactcttgtcctgacctccactgttttgcacgcttcccaaccaactggaagcaggaggcagagatcccattggtgcagtccattggggaagccatacagaaaagagtagaggaaaagcatagagaagggtagaaagagagtggattctggagaggcaaaagggaagatatttattacccacacattcttttagttaatcctcacaacagcttatcctcctttcataaacaaggatactaaggcttgagaggttaagaaccagcaatttgctaaaaatcaaatgtaaaaataggaaagggatattaaataatggaggtaggatttgaactcaggcctgtctgacgggattgccccactggagttaagaatagcttagcttggccgggcgcggtggctcatgcctgtaatcccagcactttgggaggccaaggcgggcggatcacgaggtcaggagatcaagaccatcctggttaacacagtgaaaccctgtctctactaaaaatacaaaaaattagccgggtgtggtggcgggctcctgtagtcccagctacttgggaggctgaggcaggagaatggcatgaacccgggaagtggagcttgcagtgagcagattgcgccactgcactccagcctgggcgacagagcgagactctgtctcaaaaaaaaaaaaaaaaaaaaaagtatagcttagcttaaacaagcaactctgcagttggcctatcaccatcagcagtactgtgctaagttctgattggttgattagcttgttgtctgattggtccagttgtcagtcagcgatgtacattgcataagtgcaggttctagcaaccatttttttgcacttaagtaatatttgcattgtccattgtccagtacctaatagcttttgttttaagtaaatatttgacaatgtccaactgaagagattctatacatgaaatgctcaacatataatgtcttctttaaaagcctgatgaaatgtggctttggtatgattctatggcatagtttatataaccagaacttatgtgacaaatgggtaacatattcaccttgtaatgactgagtattttgaaatcttcaattaggtagaaagaagttttattgcaacctagctccaagtctgtggtctggcaaggcccttgcatatgtgaggtccagggcactgggccagggcttcttaaccctttatgatccttgctgtcttctgctaaacacgttgtgcacatgtaccctagaatttaaagttatatatatatatatatatatatatatatatatatgtaaatctcatgtgccaaccaaaccccaaatttggaatatggctctctagaagggcatagtctgtcttctgtgatcttcacaagttcagaagcttagtttctatgattttcatgctcaaaagagtagtggttttccccaaatctgacgttattgaaaactgaacatgaacatgaacatgccctttcaaacgaataccttctcccattctaaaacggtcattcttcactttagaagattgctgctgcaaagccaattctgttcctgcctttcttatctctctcctccatttctctatcctccaaacccctagcatcatattaaacatgtatcatgtgctaataaacactacaaaatgtgatctggctgatttaaagtctaacctgaggcttgcaaataactacaagcaagtcatttgacctacttcattaagtctggccaaaaatatggttacatgcttttatttcttcagttaattgtttgagttaccccttctctatcaggaaatcatgtatccccttttcgaggtttttccatccctatagtctaaaaatcctgagggtttcctcagctcacagggagccaaaaaggtaactgagtttgagggatctaccactgctgttgcttcttgctgtcacttggtgtcaccttgaagactggttcagtgaagataatatctacctcacagaggtgttgtacaaattaaatgagcaaatacatttaaagtgcttagtatatcgatggatacatggcactaagtaggtactcaaagatttagctattaccttatgttatcaggccttagttttatgtagggtctacaccagaggatccctggaagcatctcagctttggcaaatggtgaagttagttcagttcctgcccctcccagaagcctctatcttactcacattgtcctgaagttgatctgcctctagtatatggaagagacagaacctaaggagcatagaattttttataaagcaaatgatttgttctggctcagagaaggagtttttttttaattgtaatctggtgtgtttggactgaaaaaacattgtctcaggtcaccgggctggttggtagtagctgggccttaaccaaagtcttcctgaatgcagagcttgatcaactcaagaagtaccctgctgtgctttagaaagcaatgttctggacagcaaggctgtggctcatttattttttcattctccccattctgagcacattgctttatacataacaagaaatagctcttctccatatcaactgctgttaaagatagtcacctgtgcacacatgcaaacacaaacacattcgcacatttaggaattctctctgccttccatctctttgtttctccttctttcctacttctaggccataataattaagaacaaaatgcacggtgcatataaaccttttcttcccctttgagtaactattgttgctttacaacgttccctatctctgttttaattaccagatttcacaccatcaagaacacaccattcttggaaaatggcaacaccttatctcctctttaataaactttgtgagtagcacatacaagatctccaaatagtaatttattttaggtcatgtgaaaaaggttcattgcccacatatattaaaaggtaatgaatcattaatgtaagctaatcccacttgccaatccatttatccatttgggttgtgtgctaaaagtccattcataagtcaatttgcagccaggtgtggtggttcatacctgtagtcccagctacttgggaggctgaggcaggagaattacttgaacccaggagacggatgtggcagtgaggtgagatcgcaccactgcactccaacctgggagaaagagtgagactccatctcaaaataaataaataaataaaaaataaataaaaatgagtcaatttgcttgtttctgtgggtaactatattatctattattatatcatattatatataatagtgaataataatagcagtaataatagctacagtttattaagtaccaggtatgttacacatattatctctgcttttcacaacagccttgcaaaatgaatagcccattttatagatgaaactgaggttcaaataagttaaggaacttgcttttaagcacacaaagtcaaaaatatttcctgcctcaagtatagctcctcctgaagtggtagtggtgggtcactcatgactttcctcaccacatctgttgggccccagggtgggcgcctgaccgaacgccagccaatcctggttaaggcctgatttgaaaagatgaacttggccaatcagattctcccttaggaatttgaattgggaaacatggaaagagtcaataagttggtaggagtctagggctgaaaggcacaatggaaagttgttaaatgagtgttgtgaagagaggctgaggaggccatgatgggccggcctattagagctgaagctgtggggcagtggaaagcaagcagcggctttaatgcagtggaaggaaatggagtcagtgggggtgggacagaaaggatcatgtgcagagagcagccaagttggtgcagagcaccttctctggggccacattctgcccctttcctgcttttccacagtttcagttccagggtagtcttaaaagaaatcctccatcctttgagctaatgttagtgagtgtctgttagtgagtgtcagttcctttcaaccagaagagccaaattaaagtacatggctagtaagtgctggagaggggatctgaacccggggtttgtggatacagagtttttgttcttgtcactgcacccctttgctacattacaaatgccactgtggtctaccacagcctatgaggtcgccataatgtatctgaaaaagaacgaatagtgaacccaagtttcctgaatccttgtcccaagtcttggtttgcttccagagccctggaggagaaggtgagggctaagaaaatctcagataactgggaggcctccagacaacattgagcttctagggtggaagggactgcaatggggagaggggatggggacaggggagggatcggttctcgtcagtgcagagaatgggggctccccaagggcagggattattggtcttatccctacttctatccccagattccaagatagtgcctgccacttatttgaatgagtgagtgaatggataaataaatggcagaagtgagtcatagcccctgtccaaatgtatggatcattcttcagtctagtgtccccaggttaaggaacacatcttaacctgtctccatctctaagaaacaattgatacagcacagtgaataatgtttaccatgactgatccactttagctttaaaaatcacaaagatgatgtagtggtgactgcaatcacggcacagttcaaagactacaaatggacaactctggattgcatttgccttgtttacaaaaacaccgcttgctttgtctggagagagtgaggttttcattttaagaggctgactaaaaaatgcagggccactttctgggcaggcttccaagtgactacatctttctcacagcgttccccagagccccagcccaagctgcctggggcagggcctctagccgctagtcgctgttgaagctaccacaggagaagtcatctgcagcctgcccaaattgctgtgcttttaagccttcccaaggcacagataacagctttggcctttgcattgaaagagacatcagagtttgtcattggccaagctggtgtgtgtgaaatataggagatggcgtgccacgcttctgagtatggcactctttccagccaagtctcctgggtgtgggtgagtctaaatgtttgaagactgccctcggttgtgaaatgttcgaagctgggcattgtgactttccaagggcatgacttggcgtatttcttaactctaatgagcctcagtttcctttttgtgaaatagggatagtattatcctatgctctagaaggatagaagtatctattcatcacggggtgctgcgaagcctaaaagagataacagcagagtatctcatctagtacctggcatactatagacactgaagagcttttgttatttctgaagcatcagtaaaaaacaaaccaaaaggtttcagtgatgatgccctatttttatgtctaacagtacagtatttctctgagactcagtggatatatttgacttcttaatcatacctgtgtagccaacaggaataaaacttcagaggaagttagtgccaaaggaaagtttgtcagactgtattccctttctttttctcccttctagaccctgactgcacctgccccatttgctgatgaaaccaactgccagtgtcaagcaccccatgaaaaactgaccattgctcaggcccgcttaggaacaccaggtgaggctgtacttctttgtcttaaatgggccctgtcttgacattttaaagtatcagaaaggggccgggcgtggtggctcatgcctgtgatcccagcactttgggaggctgaggtgggtggatcaccttgaggtcaggagtttgagaccagcctggccaacatggtgaaaccccatctctactaaaaatacaaaattagccaggtgtggtggtgcacgcctgtagtaccagctacttactttgggaggctgaggtgggaggactgcttgaacccgggaggtggagattgcagtgagccgagattgcgccactgcactccagcctgggcaacagagcaagactccatctcaaaaaaaaaaaagtatcagaaaggcccatcattatttgtgcagcacttgctttcaagcagagagttgaacttagagattataacgcagtgcaagggtaaagaagggtaaacactagcagtgataaaccagaccaaccaaaggagccaagaaaaagatgcatcagaatacagggagtttgagccccagctttgtcacttgttagttctacagccttgggcaagtcactagaaagatctgaatctgtttccttaaaacagggataacaatacctacctcacaaggtttctgtgataactagattcatcaaaagtaccaaagcatttttaaaaccatgaaggcatatacaaacctaagctactataattattgccattcttaaaagtatgcattttttaaaaaaagtttctagtgtgccttaaaaagagtgggttgtgctatagaagtttgttcattcattcatccctttagcattatgccagaggatggatagggaagagatttggaaagaattataaggtaccatctgtttttcaagagacaagacaactagatgtgaaataaaaaacattagtagcatgtgtgcaggtgcttaggggttaaaacctgcaacacagatgataactgattcttagagaatggcagattcatttggcctgagtgatcatgcaagacttccgggagggagcagaacagacattttaggagaactaagatttggactgtgtgggcagaagatgcaaaggtattgcagacaggtggaagaggaatagtgaagacagaaatagacagctgtgtaggagtgagtgttgttttagttgattgggatggggtgaaaaataagactagttgaacaggtaaactttaagccatttaacatggcataactcggccgggcgcggtggctcatgcctgtaatcccagcactttgggaggctgaggcaggcaaatcacttgaggtcaggagttccagaccagcctggccaacatggtgaaatcccgtctctactaaaaatacaaaaattagccaggcgtggtggcaggcacctgtaatcccagctactcgggaggctgaggtgagagaatcatttgaatccagaaggtggaggttgcagtgagccgagatcacaccattgcactccagcctgggtgacagagtgagtctctgtctcaaaaaaaaaaaaataataataatataaaataaaataacatggcataactctatggtttctagttgccattgcagaaaacaaacaaaaaaaaaaacaaacaaaccaaacttaagagaatccatggaatgaagaacagtttgcttaacaataataatggatacttattaagtacttactatgtattaagatctttatatgtatcatgtcatttcactatcacaactctatgtgattagtagttttagtatttcacagatgaggaaatgaaggtttagagaagttgtgaatctgcacaaggtcattcactactaagtggcagtggttcacactggagcctgcattagaatctactagagggcttcttaaaacccagatggctgggttccactcctagagtttctgattcagtccaactggggtggggcccaagaagttacatctctaacaagtttccaggtgatgctactgctccagggatcacactgggagaaccattggtaagtggtaaagttgggatttggtctcaaacctattggtcttagagcttgacctctcaaccatgacactgtgcttcctataagaatagccttcaatagagtgaagtgaggagcagagtaggcagagttaggaagctttcgtgtgagctgcttttgaaaaaggcaaaacaaggttggggaggtagcacagagcagccaaagctgttgttcccaggctttagtgtacaaagaatcacctggtatgcttgttaaacaagcagatttcctgtttcattcccttcttcccaaatctgggatggggcccaggcaagccatctgcattttaaacagatagtcagggtgattctaaagttagtggtctggagaccacacacagaaataccaacccagcaatatatccaagggatgccaaataaaagtccaggtggctgaccgggcgtggtggctcatgcctgtaatcccagcactttgggaggctgaggcgggcagatcacctgaggtcaggagttagagaccagcctggccaacatggtgaaaccttgtctctactaaaaatacaaaaaattagccaggcgtggtggcgcatgcctgtaatcccagctactcaggaggctgaggcaggagaaacgcttgaacccaggaggcagaggttgcagtgagccgagatcgcaccactgcactccagcctaggcgacagcgcaagactctgtttttttaaaaaaaaaaaaaaaaaaaaaaaagtccaggtggttatgaagaaaacagacttgacctaaagttaaagggtgagcatcaggcccaaactgaaagggcctctacctttctagggaaaggaaagggaagtagaacttactatatatctgtatatatctgctcgatgtgatgctctgtactctttgcaaagaccatgtgagatgactattattgtatcctttctaaagaggagacaaaggagacttgcagaactgaaaagtaacttgtcaagtgtcctagttgactgggtagagctggaatttgaccccaagtccattttgcctcaaacccctgctttgcctactgcaacgatctgccttatgaatcatggtccacagcaggccatggagctaagtgaaaacatgctcagacagtagctgtgatcttctgtagtggcaggactatgccatgctcactgctgtttcatcagcatctagagaaatacttgttgcatacgctgcggtcaataaatattttgtgagtgaatgaatgaaagtttggaggcaggcgggtcacctgaagtcaggagtttgagaccaccttggccaacatgatgaaaccctgtttctactaaaagtacaaaattagccaggtgtggtggtgcatgtctgtagtcccagctacttgggaggctgaggcaggagaatttcttgaacctgggaggcagaggttgcagtgagctgagatcgagccgctgcactccagcctgggcgacaagaatgaaacttcacctcaaaaaaaaaaaaagtgtgggacaagagaagtagttcttcctctggaaatagaagcagagagagtttgttctggcattttgagctggtatcaagctaactgggtgaaattgggcacctgtacattgcctgctgccaagcagtttaagcagtaataagatggtggtgtattttgaaataatacaggtcattagagggggagtgagatggaacaaagatgaactcctgatctttagaagagaaattctgcccactaacctgaggtgatgaccctgggaaattatctaagaaaatccgtgatgttgatgagtacctagccagggtacttgtgttagaaatttctttatttagaacttcaaatatcaggccgagggcggtggctcatgcctgtaatcccagcactttgggaggccgaggcgagtggatcacttgaggtcaggagttcaagaccagcctggccaacatggtgaaaccctatctctactaaaaatgcaaaaattagccaggcgtggtggcgtgttcccaggtgatgctgctgctgctactagtcctgggaccacactttgagaaccacagcataagagcaactgtcggcagtggttagaaggagtggtagggagattatccaatatcataattgttggagcattgtactgttagcagaaaagctcggagaatttttaagaatcttgctgtttgattaccatttaagaaaacaagaaaaacgttacttttttgaagggtttgttcaagagtttcaagaagggtttggtcaagaagggtttggtttcaagagtttcaagaagggtttggtttcaagggtagtaagcaatttacctgtttgtggcactgtcttgagcgtgccctcaaaaaagacaaaacatagcagaatttggtatttgataatgctcttcaagattatagttttttgtttgtttttcttttgtatttttagtggagctggtttcgccatgttggccaggctggtcttgaactcctggactcaagtgatctgcccatctcagcctccctaagtattgggattacaggcatgagccactgtgcctggcctagattatagctataactggactctcttaccatctcctacactagccatattttatgacataatataattgcctaaaatgtgttttacaaatttagaactgcccaaacaggggctgggggtacaaattctagaagaggtaatgacaaactctgcccatagctcttagctttttgaccttgtttgtgaggtcacaagggtgatgaaacttcaagagaaagaacagaataaatcaaaaaagcaatcagaatcggcacctttggtcttagctagtccagctgtggagctgtgcacatacacagtgttgtatgtattctgatgcatggagaataaatcctgtcttgacataaaggaaaagtccaggagattgtttcataggttccttttcattaaaactgcctttcttttctctctttctttctttctctctttctttcttttttttttttttttttttttttttttgacaggttgttgctctgtcacccaggctggagtgcagtgttgcaatcacagctcactgcagtcttaacctcccaggcccaagcaatcctcccaattcagcctcccaagtagcttggaccacaggcatgtgccaccatgcctggctattttttgtattttttgtagagatggggtttcactatgctgcccaggctggtctcaaactcctgggctcgagccatctatccaccttagcttcccaaagtgctgggattacaggcatgagccactgtacccggccctaaactgacttttcttaaagggaatctcggttctgattttctactttccttttcaaaaaggaagtttgtattatctgtttccacagtgtgtagaatttccctgactacatttttcaagagccgccttaatgaatctgccttattcatgtatcatctgtgatgtaatttacttaataatttttctttacatatactcactgttctaaaactttaatgtattttaaaaagcaaacatcaatcactatcatttacagaaaatagtatcattagctagtagcaatggctaatgataagcagaaggtaactacaaagtttatataaaactacataaattatataaaataaatatgtaactataagattttaaaagcttaacttgtgccactttttttgcacatcagttatacaaaaaacagtactagttgccataattactgggtgtttaataatagtttctgttttgttttaaagacaagaattcatatcagcatgtagttttctagcaggtaccaacaaggtagaagaaagagtggtgagtttgatttgcactcaaacatcatcgtaaattggttgtatgacattgggtaagatgcttaacttcactgagcctccatttgcccatccatgaaatgataagtctactttcacctggctccctcatagggttgatgcaaagattaagtgaaatacatgtgttttgtgaattgtgtgtatttctaaggtactgtttaaatgccttaaaatagccacaatccaagccttgttaatagccataatcaaagatgatcaatcactattttattgttgcttgaatctgaagcaaataccaaaaaacgcctaacataccccacagtagtgtgaatttaaacgtaacgtggttggtgattacctcctgtttggctgtatggcaggtgtgtgtttaactttttaaacaactgccaaactgctttccaaagcgattgtaccactttaaattcctatctgcagtttatgagcattccagttgctctgcattctcaccatcacttggtatggccaattaaaaaacattttttagccattctagtgtgtatgaagtgttatctcattgtggttttcgtttgtatttccctaatgactaatgttattgaggatcttctcttgtgtttatttgccatccttgtatttattttctttagtgaaatgtctgttcgatatttttgctttatttaactgggtggtgggttgttcatcttactgaggtttgagagttctttatatattctagatacaagtcctatattttgcaaatattttctcccagtctatgactcaccttttcatttttgtaaaaatgtcttttgaagagcaaacgtcatgagtctcacaggctgcatttaaggtgtcaccccaggctcagttctcatctggaggttaactgttgttagatctgcttccaagctcactcaggttgttagcagaatttatttccttgtgactgtaagatcaaggggtgagcttcttaccagttgtcggccagaggccaccctcagctcctagaggccacctgcaggtccttgccatgtggccctctccataggccctttcacaacatggcagcttgcttcttcaaagccaccagtgcagaaagacagtaagtctgctagcaagatggaccctttttgtttctttttgtggttgttgtttttgtttttttttgacaaagtttcattcttgttgcccaggctggaatgcagtggtgtgatctcggctcactgcaacctctgcctcccgggttcaagagattctcctgcctcagcctcccaagtagctgggattataagcgtccgccaccacgccaggctaattttttgtatttttagtagatacggagtttcagcatgttggccaggctggtctcaaacttctgacctcaggtaatccacccacctcggcctcccaaagtcctgggattacaagtgtgagccaccacgcctggccaagatggagtcttataatgtaacataatcatgggaataatgtctaccacctttcccatattctactgattagaagcaagttacaggtcccacacgcacttcaaggggtgggaattacacaaaggcatgggcaccaggaggcagagatcattaggagccaccttaacgtctctccacgatagccatgcaatagttgtactctgacatctttttttgttttcaattggctcctggtcattgccaaacctccagcttcacaggtcagtggtatctcacatagatgctctggaatctcacatagatgctctggagagtccccagatgcctaaaagcatatccagaaaaatctcaaacaaaagattaaaacagatcaacatacaaactaaaaagccatactctgtttttttttaaagctttattatagagtatttcaaacacacacagaagtagaacaatataatgaaccttcctgtgcctgtcactcatacctaacaaccactaacccatggccagtcttgcaccatgcacacctctgtctactctgtcctcttgaatgatttgaaacaaaatcccagacttcctagaattctgtgtatatgtctgaaaaataagagctctggttttattaaacataaccactgtatcatgatcttacctgaaaaaacaataattccttgatatcaccaaatattcagtgttccaatttctaattatcttatgtcatcatttatatatagcttgtttgaacccaataatgtccatactttacagtaggttgatatgtttttaaaatctctttcaatctgcagatccccctttcatttctctttttctttctctctctctcttttttgccttgaagtttatttgttgaagagatgaaagatcagggtccttttttggcagggaggggagtcctggagaatttcccacagtctggaaattgctgacacaccacaatttttaaaagtgagcttattgcaaaatcaactttgtaaatactcttcagatttactaaatggcctttttctcagtaattacgtcttctttctttacttttctttcctccctgcttcctgaattcatttctcttgatcacctctgaatcaataacaaaaagttttacaaaactgccatctgctttcccctggggtttatatcttaaaacaaattttcctcaattgaattcacattgaataagaacattgaaagcaaggctccctcattagacagtttgttatttcaaagcattttctatttactgtgccttatttagaatacagtataatcctatgaaggcaattctgtttgttcaaatttgtgtataattggaaataattgcaattccctatctgacataaagtctctcaactttttttattagagaaatttaatttattagaaacattgtatcatctgaatctattaatgtaacatttctttatgttccaaattaatgaggttgcattgcatcaagaaataatcacaattttaaatctaagtcttaaagatcatttaacagaagttggcattgatttcttttttaaatttatttttataacatcaatgtaatacatgcatatatatatatatataatttgagacacggtctatctctgccacccaggctggagtgcagtggcgcaatcagctcattgcagcctctgcctcctgagttcaagtgattctactgcctcagcctcccgagtagctagtattgcaggcgcctaccaccatatctggctaatttttgtatttttagtagaaacagggtttcaccatgttggccaggctggtctggagctcctgacctcaagtgatccacccctgcctcagcctcccaaagtgcatggattacaggcttgagccaccacgcccgactatttttaaaagtcagtagtactcccagcttataaagaaaactagcggtccctttctccaccttcttcacccctgattcttattccctgtaggcactcaacacttgacagtcaactttccataatgttgttgacatctctcatccattgtcattgcctttcttgttttctctgcccttgggaggattatatctttttaacttaacttttaactttaacttttaactcttaactctgtaacttttaactcttagtaattgttgtggtgtttctgggagaaagtagagataatgtgtatgttcagttcaccatatttaactgatggtctttgtatttccttttaaagaacattattagctcacgcctgtaatcccagcactttgagaggctgaggtgggcagatcacaaggtcaggagtttaagaccagcctggccaccatggtgaaaccctgtctctactaaaaatacaaaaattagctggatgtggtgctgagtgcctgtaatcccagctacttgggaggctgaggcaggagaattgcttgaacccgggaggtggaggttgcagtgagccgagattgcgccactgcactccagcctgggcgacagagcaagactctgtctcaaaaagaaaaaaaaaaagaaaacaaaacaaaaaacactattgtggccacatatgtctctttccttctcactgcaagaataaaatgtctctatgttgtttgtagccgtggagatgaggtgacaagggtgcttagaatgagagcactttgatatgagaaactacttctttctcctgtcatccatttttgaatcttcttggattttcacattctagttcctttgttgagagtctagaaaggtgtcaaggttggcaaaatacatagaattttctatataaatgtaggaggcatcttccagagtatcatgatggggatataacagagctgcaacttccttcctccaaccagttaaaaagaataattttgtgacttgctttgtctaccaaattgatggaagtctatacccaatttctctctctgacttgaaggggatgggtctttggcctggctgagcaatagtgttatcctggtctcctggttcctggaggtgctgtactgaagtgtgtccctcttcctcttggaacagcactttttagagcactagatgccactgtctgtgtgacctcttcacttttgacctttctccctaggaaggactatagtgttggttgttcatcttcagccctgagcaccacttctacatgcaacattacatcctgactctcctccctttgaggcgtatgtccctaatctcttattataccaaagaggttagggagtggccttgcagtggtatgctagtaaaggtttaacagctggtcctctagcgggaaataagccctgatttgtagcatttgccaacttctgtcgtggaagcactctatcgtggctgacttcaggctaccaacgtgacctggagttgggaagaaaggttgtaaggtgagccatgtgaacagattccagtacatcgttgcctttgagaacagggacttggggtcttcattcaggactgccacacccaaggatgaagccatttgccttttccattgagctcctcagttactcctgcctacgtgttccagctgggctgactctgccggctcaggcacctagactccactctgggtcaagagaactcctcagtgctctgtttttgtctcttctgttggctaaaatagtgtgttccctggtttgatcttaagtttgttatgtttttgctctgctttgatgtcttcagaagaacccctttaaaatcaatttcgtgcactgatatgaaactgatggtatgtagagattgtgtcttatccagaaagtttcttacgactgatagaaggtaactgggattcctcattctgcagttctgttaacagtgttttctttctcccacagctgacaggcctgtcagagtatacgccgatggaatatttgacctcttccactcaggtcatgcaagagcccttatgcaagcaaaaacactgtttcccaacagctacttgttggtaggaggtaagaagtgcattttctttttgtctagaaaactcttttattgtatgctttctgaaaagagcccctttcagagttccatcagtaaaaatctcacattgttaatgcttccaattcagcccatactggctcgcttgttcactgcctgaaatttaaaatgatgtttgaaaaaccataggggaagttacatcatgggattgtataaccctgatcctcagagagagatggactgatagtaccaccaagggtaaatgcttcatgttttccattaatgcctttctattagtgtttaaggcttgatccaaattatgttcctaaaattttctagagggataagagaagcaatattattctgatttcaaatctcaaagaactaaagggagttaggatgatgaagaacaaacaaggtcatcgtctatttcttttgtgtgacctgcagcacttaagacaatgttgtgctaacactagtggcttgtaacagccccacttagttgaatttgtagcagtgtgttaaagacatggagatttatataccgaggtaatcttggttcacaacgaagggaccaatttactcgctaagtctatggaaagagaaggatcgttagatgtggactgaaattttcctcctccaggaggcctatttctttttggctaaaagggatagtacctgactaggaagacctgtatttcacttgtgcagcttcaggaaggagcatattcattcagagtaatcagtttttgtggcatataaactaggcaccatcaagtcttacacctctactgggggaaaaaagtactggtaagagactacataactgttttttaaagaattttgttaccttctgcaattaaaaaccactttgtttgtttgtttgtttgtttgagacggaatctcactctgtcgcccaactggagtgcagtggtgcaatcttgactcactgcaacctctgcctcctgggttcaagtgattctcccgcctcagcctcctgcatagctgggattacaggcatgtaccaccacgcccagctaattttttttgtatttttagtagagatggggttttgccgtgttgtccaggctggtcttgaactcctgacctcaggtgatccacccacctcagcctcccaaagtgctggcattacaggcgtgagccactgtgcccagccaaaaaccacttgttggacatttaagaggaactcttctgcaggttttgccaagggtggtgaccacaggaccattgaatggagttctttccagaaggaggaaatggtggaaggcaatggttactgggcaagtcatgcagagggaacccaaaacaggcagagaacccaacccttgcttacttccctttagcctgaaaaccattccttgagagagcactaccacctggagtctggtcctaggctactggggccctggagagacctctgcagtgtttgggctttggtcatttgggtggcctaagtttggaggtggttaggtgtgggtcacagttaacaggaacactagctgtggccctgggttatcacatccaaagtaagataaaaggaaatgtgtagttttcagtacgttcttgtaaattggaggaggcagtcagttaatatcagcagctctctaggtcattaggcaacaatggtttcactgactcactgatttcttcatctgacaactttcttttttttttttttttttttgagatggagtcttgctctgtcacccaggctggagcacaatggcatgatctcggctcactgcaacctccgcctcccaggttcaagtgattctcctgcctcagcctcccaagtagctgggattataggcgcgtgccaccatgccgggctaatttttgtatttttagtagagacggggtttcaccatgttggtcaggctggtcttcaactcctgacctcatgatccacccgcctcagcctcccaaagtgctggattacaggcacatgccaccatgcccggctacttttttgtatttttagtagagacagcatttcaccatgttggccaggtctcgaactcctggcctcaggtgatccacccacctcagcctcccaaagtgttaggattacaggcgtgagccaccgctcccggccccttcatctaacaactctttattgaactcttactatgtgccaggcatttttctgtacactggggatgcagccatgaacaaaacagactgtctatgtcctcagagaacttgcagtctgagggagaggcagtcattgcccactaaacaagtaaatatgtagtagtggtactatgaagaaatataggaaaagagaaaagagtgactgggcggaggaaggagggatgttttaggtataaaggtcagggaagacctctctgaggaggtgacatttgtgcagagacctgaatgaaataaaagcactcaaaagccagaacatccagtcttccttgtgcaggattctcaccagtcaagacaacagtgtgaggcaagcagagaagacatggtgacatgttagttttttgatttgtgtatcttaaggaggctttccataaaagcacagatgattcagtactcagggaaattaatatgggcagaagtttggagccaagaaataaagcagaagagaaggagaaaaatttcaataagaaatcctggactttttagcagctatagcaaagggggccacacagtcattctatcactctcaaactctagaagctgaattgtaccatcaggaagaactagtttttcctgcctgagttctgagataactgtttcagagggtcactgtgtaaggggcattgagtaatccaaagaacgatgtcctctatagtaggtttacacagaatttcagatattcccttaatggctattacatgggttgtggaagtcaagggcatattgaactacttggatgaccatgagactgtatcctttggtaagtgacaaggactggagtacaggaagaaaataaaacaatacagcatcaagctataaagaaatagtatgtagacttctgggaacagtgacagagtaagagtgaaagctgggcatggtggtgcatgcctgtagtgccagctacccaggagactgaggcaagaggatcacctggacccaggagttcaagggtatagtgagctatgatcgtacctctgcatagctattgcattccagcctgcacaacacagtgagacttcatctctaaaacaaacaagaaaaacaccaaccatgggcaacacaaacaataataaataatttcagtgtgttcttttctctgtagatttcttattcttatcatctcatttaaaataatcgaattgtaatactatgaaatatcttctaaccactctgctaataaaattcagtgacatcctggctgggcgcagtggctcacacctgtaatcccagcactttgggaggctgagttgggtgaatcatctgaggtcaggagttcgagaccagcctggccaatgtggtgaaaccctgtctctactaaaaatacaacaaaaaattagcctggcatggtgctgcacgcctgtagtcccagctacttgggaggctgaggcaggaggattgcttgaacctgggaggcggaggttgcagtgagccgagatcatgccactgcactccagtctggaccacagagtgagattctgtctcaaaaaaaaaaaaaattcagtgacatcctgtatttcatatgtctccattaatttaatatttgatcccaagtctgttaaatggaatctctaacctcctgtgtataggcagactgctatgggggcatggtataagagctcaaatcccaagagtggcattgctgtctgggtgtgatttcccaaatggtgaatgcctcttggtaaaattgtaaacaaaacaaagtgcaatcttcctttgatgtacatagtaattgccttcctctaaaattctgtgtctatcataactgttgcagaaatactttgtgattgtatgcaaaacaaaggcagattctagactcaaataattttatttttctaagttttttatttaatcatttttttttttggagatagggtcttgctctgtctcccaggctgaagtgcagtggagcaatcacagctcactgcagcctcaaactcccgggctcaagtgatcctcccatcttagcctcccaagtagctgggactataggcacatgccaccatgcctggctaatttttctgtttttgtttattgtagagatgggatttcactatgttgcccagactggtctcaaactcgggctcaagtgatcctctggcctaggtgtcccaaaatgctgggattacaggcatgagctagcacactcaacctcaaataattttaaatattatgcagggactttcaaaaatcttgcagggatgtgggaaaattctcatgcagagctgccacatgcattgcaagatgactagcttcattggcccctgcccactgaatgctggtagctgcctccaaccattatgacaattaaagatggcccacagatttccaaaatgcttcctagagaatgatgaaatccttgttgaggaccactgtcttagactaggagtcttgaaattttgttccccacaatctctaaaagaattttgaaaaatctgtataccttcttatacagtttaaagcagatgtctaaaatttatatatcaggccgggtgcagtggctcacgcctgtaatcccagcactttttgaggccgaggcaggcagatcacatgaggtcaggagttctaaaccagcctggccaacatggtgaaaccccatctctactaaaaatacaaaaattagctgggtatggtggcaggtgcctgtaatcccagctactcaggaggctgaggcactagagccacttgaacctgggaggtggaggtttcagggagctgagattgtaccactgcaccccagcctgagtgacagagcgagacgccatctcaaataaataaataaataaataaaataagtaaataaaatttagatatctgcttcttaatttaagtagttataaaagatgtaaattctggaatattgtgagtattagcctttttaaaaattaataaactttattttttagagaagttttaggttcacagaaaaattgactggaaagtacagcgaatccttgtatactcctttctcgcacaggcacaacttcccctactatgaatatcctgccccagcctgatgcatttgttacaatccattagcctacattgacacatcattatcacctcaagtccatagtttacattagggttcactcttaacgttataccttctatgggtttggataaaattttacattgtccaaactcatagatgtacattgtataatgacaggtatccacaatgatagtatcatacagatactatttttactgccctaaaaatcctatatgctctacctattcatctcttcctccctgtaacccctgacaaccactgttctttttagtgtagttttactttttctagaacatcatataattagaattatacagcatgtagctttttcagattggcttcttttacttcataatattcaattaatgctcctcaatgtcttttcatggcttgctagctcatttctttttggcgctgaataatgttccattgtctggatgtaccacagtttatccattcatctgccgaaggacatcttagtggcttccgcattttggcaaatatgaataaagttgctataagcatccatgtggaggtttttgtatggacatacattttcagttcatttggataaataccaaggagtgtgattgctagactgcatggtaggaatatgtctagttttgtaagaaactgccaaactgttttccaaagtggctgtaccaggagtgggtatagctcagaggtagagcattcaactgcagatcgaagtggctgtaccattttgcattcccaccagcaataaatgagagatcctattgcgtcatgtccttgccagcatttggttgtatcaatgttttggacttttgtcattctaataggtgtatagtaggttgttttaattttcaatttcctagtgacatatgatattgaacatttttcatgtgcttcctggccatctgtagatcttctttggagaggtacctgttaaggtctgtagcccattttttaaaatccagctgttttttttcttattgttgagttttagagttctttgtatattttgggtagcggtcctttatcagttgtatcattttcaaatatttttcgcccagtccatgtctttttttttttttttttcgagaaagagtttcgctctgttgcccgggctgcagtgcagtggcacgatcttggcttactgcaacctctgcctcccgggttcaagcaattcttgtgcctcagcctcccgagtagctgggattacaggcatgtgccatcacacctggctaattgttgtatttttagtacagacagggtttcaccatgttggccaggctgttcttgaactcctgacctcaggtgatccaccaacctcggcctcccaaagtgctgggactacaggcgtgagccatcgtgcccggcccccagtctatgccttgtttcctcattctcctaacattgtctcttgcagaacagaagtttttaattttaataaagtccaccttatcaattgtttctgtcacggttcatgcctttggtgttgtatctaaaaagtcaccaccatacccagaagaaacccatctgggttttcttctgtagagttttatagtttggcattttacatttacatatagtttggcatttacatttgatttttgtgaaggatgtaaggttatgtctagattaatttttttttttttttgcatgtgaatgtccatttgttccatttgttgaaaggtctatgtttgcttgcctttgctcctttgtcaaagactggctctctgtatatttgtctgggtctatttctgggctttctgtctgttccattgatgtatttgtctgttctttttgccaataccacactgtcttgattactgtagctttatagtaggttttgaagtcagatagtgtcagttttctgacactttcttctccttcaatatcaatttggtttttctggatctttttcctttccatataaacttttatttttatttttatgtattttttaagagacagggttttgctctgtcactctgaggccctacttgagctcctggaggtaaaacccacaaaagtatttgtcccctggcttcttgaactcttagacttgtccacactgaggtgccagcgatttgtcagtttaaattttcctatcccagcactggttcctggggaggtagctctgcttgtgggtttctgctctagtaagctaatattctctctatctgcctgtttctctctccaattttgggagtagtggtttgccctgtgacctcagttctctgatggatctaagaagacctgtagatttgtcagtttgttcagtttttacttgttgtcaggaccgagtggccacttttaagctccttacctaccagactggaaaccagaaatccaatattgacattttaaaacaaaattatgggccaggcgcaatggctcccgcctgtaatcccagcactttgggaggccgaggtgggtggatcacttgaggtcaagagttcgagaccagaccagcctggccaacatgatgaaaccccatctctactaaaaatacaaaaatactagccaggcgtgcacctgtagtcccagctactagggaggctgaggtgggagaatcgcttgaacccaggaagcggaggttgccatgagctgagattgcgccactggactccagcctgggtgacagagtgagactccatctccaacaaataaataaataaatacataaataaaaaacaaaattgttaccccatcactttaatgcatctattggcatctaaatactataatgctttgaaatatatcatcaacaatttacaaaacatataacaagctattttttaacttttaaatatttataagtttcattttttccctcaaacttatattttcattctgcttctctcccataatttttcctaatgtgatgtgttttaatgtttgcaaatcttttagtgatcactgtatcatacttctctgaaacaaaaatatgtatataaattagagcataactaaccaaagcaccacattatatacactttgataaataattgttaacatagacataaatttggacagcaatgtatctcttaatgagatgaatagtatgtacctggagatgtacttatggatgaatataactgactgctagaatgaggcagggtttaacatcaattttatccctattttttccttgtcatagttataagtgctgaaatatgttgttcatgcaaatgtgtagatagaatggaaggagtttgttacagtgatgccactcaattctttgaacttctgagttatttaccaaaaataacaacataatttattattattattgccatcaaaagtaattttaatggtctatcaagtgacaatttgttaagatcctccttcaaatttgttgcaagcaatggattagaaatgacctgacctgcaaaaggatttgttgccaagctattagaatcatttgctttttctctttctgggacttctaacaaaaggctatatcaagagttattaaatgactcttaattatatcccttattcttttacttgaaagcaacttattcaactagatatagccagaaaggatttgggaaatggaaatattagtaatttaattacatcattgccaatcaagtaatttttgataaaatgcttttatcatttgcttacaaccttttttaaaaaacaaaatctcagggctacagtttcagattactaactttgcagaaaacaccatccaaccaaattggcaaaaccagtcctcattgtcaaacctactaaaaacctacaaaccaagaaaatgtcttttcaattcaaatgcattaatgtattttcagttcaaatgtattaatgtatttcaagaagctttataaaaaacactcaaaaataaatgatagaatggattatgtaaaatagaatcagtcaagattaaaatgatgtagatctaatataataagttataaacaagacaagacaataaatcaatgcacttaatttgtagtaatgcaatgtaatttatacataaaattatgtgatatttatacgaagaagagtatgatttttaaaaggcatgttattccttctctaaatattggcacacgtgtgtgtgtgagtgtgtgtgtgtgtgtgtgtgtgtgtatatatatatcaaattctagtgtttgccttttgggaataatcaaataaatatgaaaaacagaaatagttatctttagtagataccatgactaaacttttcctatgtatttaaagatagaaagggggcatatattattaaaaagtaattggtctggaggcagataataattttattttttgttataaagaggtagaaaataaacattatagacaatgagatgaattaggatgacctgtaaatagaataaatattttatgatataagttgataacacaggtttttaacttcctttttaagtaatgcgtatgaagcctgtaaaaaattatgtaaatgttttacccatgtgtctattccaatgtatcttgaaaaatttgataattctagaaaatattctagtcacatttctaagaagcagcagtaccagcctatatagctttggtttattgaagtgattttcaagtaaatagctggaaaaaagtgcttactcttatctacaagagaaaagccatttttaggattcaatatgagtgttaagaatagctgaaaaaatgcttacccttgactacatgaaaaagccatttttttagaattcactatttctttccaatgctccttttgctttgagttcttgggccttatccctaaagatccatgtgttttttgacaatagttgggagaagaggcaaagttgttgggcaaaaatttgcattattctccactctaccatattgagtttctaacactaggcttcacctgtaacagaaatgtgtgtaagacagggaaagacaggaagctttcataggttcatggtgctttgaatggtcactaactgagatttccatttggtttgccctgaaggctaaatcgccctccaccccttccaatgcaacatattaaggtttgggtggtgcctttcttttgtaaagtggagtaagcatggctttggacccagagactttcttgacctagttaatattaggaaagtgtaccactggaagttgaatctggacattgattcgtttaaaactagctgttcatggataccttttgaaaagtctatgtggctgggtgcggtggctcatgcctgtaatcccagcactttgggaggccgagtgggcggatcatgaggtgaggagttcgggaccagcctgaccaacatggtgaaaccccgtctctactaaaaatacaaaaattagccaagcgtggtggcacacgcctgtaatcccagctatttgggaggctgaggcaggagaattgcttgaacccaggaggcggaggttgcagtgagccgagatcacgccactgcactccagcctgggtgacagagcgagactccatctcaaaaaaaaaaaaaagaaaagaaaaaagaaaagtctgtgtgtgtccatgagggtatatgtatcgtagtttaaggagacctttatcttagactgtctttctggagaatgacaaaccaaccaacttaatggcagacaattctatactgaggaaagttagggaggtcttcaagaataggtgtcctgtgttgttggttgaaaggctggatcttgattactgtatgtgtggtcaacatgtaaaatgcttacagtgagttaaatgggcctgccatattaactagggtcccctttccatatgcaggtaggtttgctgtaggagttcccttgggtggagcgaagacttcactcatgaaaccactttggtcagggcaagtatggggacaagtatttggtagaaatacttggtatttgtcagaaatcatttattaaaggaccagaaactgtgataactggaggtactatagtctatttctcaaccttaggcagtaaaaggcaccacaatcgtcatggttttgccctatgattataacaccagcactttttttttttttttttgagatggagtctcactctgttgcccaggctggaatacagtaccatgatcttggttcactgcaagctccacctcctgggttcaagtaatcctcccacctaagcctccccagtaactgagattacaagcatgcaccaccacacctggttaacttttctattttaagtagagacagggtttcaccatgttggccaggatggtctcgaactcctgacctcaagtgatctgcccacctcggcctcccaaagtgctgggattacaggcatgagccaccgcacctggcccaatacctgcacttctaattttttaagcatgtagccagtaataatttgaaaattcttctatgcaagcttaccttgttggcattattttagtgaattgagactctccacttgtaaagctcttttttccttcattttaatttacaagtttgtgtcatttaaaaacaggccaaggaattaaaatttatactagtgtgtttttttccctaaaaaaatttttaaagagtcaccaaatagccacctctgcttcgcaggagggcaataaaaataacaacagtaaacatactactactactatagaagacataaagattactccacaaacttgtgtttattttattatattttaattggaactaaatattctttaagagtcccttttgcctgactggtaggaaattcagtctcagtcttttttttttttttttctttgagacagggtctcactctctcgcccagactgaagtgcagtggtgtgatctcggctcactgcaaactctgcctcccaggctcaagcgattctcctgcctcagcctcctgagtagctggaattacaggcgtgcaccactaacgcccggctaatttttatgtttttagtagagacggggtttcaccatgttggcctggctggtctcgaattcctgacctcaaatgatccacccacctcggtctcccaaagtgctgggattacaggcatgagccactgcgcctggcctagtctcagactttactgggctctctttacctccccagagtcaaacaagtgtccacaatgtttatagaaacaggagcggggcctccagtcttcaacccagggctatttttgcactgccctcactgtctgagcccagataattactagaagggagcagattcattgcacctatcacagttcagtcacctgcagtctgttcccaggtagaactcccatgcctagggcctcacattctcatctctcttgaggtcctgccactggcatctgctgcttgtgggatccatagacatttggccctttccctgcaatttggagagatctcctctctcattgtcttcttctttccagaatacccctcaagttgctctggcttcaggaaaacagcagccaggaaggcaggctgtctactagcaacttgagctcacagcacctacaaaggagtctgtaccacggggccctcatacctgcttggagtagggggcagggaaaagacagaacacaaaatctgaaggaatagatccatgagtgatcgtattttcctactactattcgtaaatggctaacattattcagcattactctctgctcataaagatgatcaaatttaattctcaaaacttcaccatgttttaaagaccagataactgaggctcagagagtttgagtaacttttccggtaatagcagagctgggattagaacccgagtctgttgggctcccaagctcaattcctatgttgtattttctctcctgtgggagcacagtgagctgccagcataggttagttgcagcatgagttcccagatagctcaatgaattcatccatggaataccgctgcccagagctctccatctggttgtcagagtgcatttgccaagactcaagaacaacagtgctgctttgggcgtaattaatgtttagacaataactggtcagcatgttcagctgcttcttgaggtcactcctgggataggaaaataggaccctgtattggcataaacaggatgtttgttttctttgtgctctatcagtaggccattatctcggtcatgtagaagttataccaaattgctcaggtgcagattcagaaagggggaggatgtggcacggcctagttttgtgctgtttaaaatagaaaatggaaaatggatgaatctgaaatccatttctgctcaatatgattctcagggtggtattttaataaggtcctaaaagaacattcaaaaagtcttagattggttttgaaatcatattgcatggcccataaagaattcctgtttatggggtcaaaaactaatatagtcaataaatcaacacatagttattatggccctactacctgtccctcctgcccaccttcccccccacctctgggcataatgggtgatttaaagacaggcagagctcttgactcaagttatttataatatgcttcagggttttcaaatgttgtcttcatcagaatcatctctgaagcttgtcaaagacagagctatctgggccccactacagactcactgaatcaaaaatctcagggagtgagctgggtttctttacatgtgtttaacaagctccttgggtgattctgatactcatcagttttcaggccagacatatggttgatgttgttttggtaatataaacttttataatagaaaacatctcaggaagtatgtataggagatatagaggcatatatatatatatttatatgcatctagaagctcattagtctctcctttgcgtgtatgttgttgaaacgttcctgtaggccaggcgcggtggctcacgcctataatcccagcactttgggaggctgaggcaggtggatcacttgaagtcaggactttgagaccagcctggccaacatggcgaaaccccatctctattaaaaatacaaaaattagccaggtgtggtggcaggtgcctgtaatcccagctactcgggaggctgaggcaggagaattgcttgaacccagaaggtgaaggttgcagtgagctgagatcgcgccattgcactccagcctgggcaacagagggagactctgtgtccaaaacaaaaaaagaaaggaagaaagaaagaaaagaaaagaaaagaaaagaaaagaaaagaaaagaaaagaaaagaaaagaaaagaaaagaaaagaaaagaaagaaagaaaggaaagaaagaaagagagaaagaaagaaagggaaagaaggaaagagagagagagagaaagaaagaaacgaaagaaagaaagaaacaaagaaagaaagaaagaaaagaaaaagaaggaacctgtagataaatataaatctattattgtaaataataataaatatttcttgagtatctatatgtatcaggctttgttaattcattcaacaaatattgttaaaagcctactaggggccaggtatggtacatcagaaaatgaaacaaaagtccctgccctcggggaatttataggggaacaccaacaataaaactaaataagacagctacatgagacaagtgtcatggggagaagtaatgcagcagaggatcacaattcagaagagggtgggtctacttgggaggctgaggcaggagaatcgcttgaacccgggaggcagaggttgcagtgagccaagatcgtgccattgcactccagcctgggcaacaagagcaaaactctgtccaaaaaacacaaacaaaaaaagaagagggtagggggaaagacttgagggagaggagaaggtgagctctatgagtatttggagcacaactattccaggtttggagaatagtgcaaggcccggacctgagaagaagcattcaagaaactgcaaggccggggagctgggatacactaggagactggtcagggaggcaaggagtgggcagaggcgtaggtcttgtcagccactggaggactttggttttactctgaatgagacaggaagggttctgaatttgggaatgacacagactgacaagcttcaacaggctcattctggccaatgagaataggttgttgggagtgggcaaggctggaatcaggagatcagttaagaggctactgcagtcatccctgggagagatgatgaaggggtggggatgggagcagtggaggtgctgagaaaaacatggcttccgggtgtgctttgaaggcagagcctgcagttttcctgatggcttgggtgtggattatgtgaagggactacaaaagaaggttttccaaggatgctgagtgtgactgttggctgtgcttactctgtggccagatttgattctgggtgtgggtcatcattcagttccaagaaaatgatcatatttttgttcttaaaacacatcttgtgagattaggcagtatttgtcttcctgtgtctggcttatttcacttaacaaaataacctccagatccatccatgttgccataaatgacaggatttcattctttttcatagctaaatagtatttctttgtgtttatataccacttatatatggaatctaaagaagctgatctcatggaaacagagagtagaacagtggttaccagaggctggggaaggtagatgacgggggacagggagaagttcatcaacgagtaccaagttacagttaggaggaataagttctggtgttctattgcacattagggtgactatggttaacaatattgtatatttcaaaatagctataagacagaattttgaatgttcttaccacaaagaaatgataaaggtatgaggtgatggatatgctaaatatcctgattagattattatacaatgtatacatgcatggaaacatcaccctctaccccataaatatgttaattattatgcatcaattaaaatttttaaattaaacacatattgtacacttaacattagtgaatttgttggctgggcacagtgcctcatgcctgtaatcccaacactttgggaggctgagaccggtggatcacttgcagtcaggagttcgagaccagcctggccaacatggtgaaaacccatctctactaaaatacaaaaattggctgggtgtcatggcacgcacctgtaatcccagctgctagggaggctgaggcaggagaatcacttgaacctgggaggtggaggttgcagtgagccaagatcacgccactgaactccagcctgggtgacagaacaagattctgtctcaaaaaaaaattagtgaatttattgtaagtacataatattttaaagaaaaaaaaatttcattgcaaagagcagtcagggtagttctgactggccaccgcaaggctctcactgggatcttggtaaacagggactgtacccacaatgatatttcttcctgacacataggagatcttaggaaagctgccttggccaaccaaaagataggatagtgaatagtatttattgttcagtttgtttaaaagcactttttttctaagttctcgaaacatcttttctaaggctgatagtggaagatatccccatttgagggttcaggaacctgagatctagaaaatataagagatgtggaggccgggtgtggtggctcacgcctataatcccagcactttgggagcccgaggtgggtggatcacaaggtcaggagatcgagaccatactggttaacacagtgaaaacccatctctactaaaagtacaaaaaaattagcctgggtggtggcaggagcctgtagtcccagctactcaggaggctgaggcaggagaatggcgtgaacccgggaggcgaagcttgcagtgagctgagatggagccactgcactccagcctgggcgatagagcgagactctgtctcaaaaaaaaaaaaaaaaaaaaagagagatgtgaaaggatgaactctactagatcaaacctttgattttatgactttcttctcttgattgagtgacctgatgtgtagtgactggccctcaatccagggaacagaagtatatgtatttgtgtgtgtgtctgtctgtctgtctcacacttgggttacaaagtacaataatctagtaaaataattggaactgattgttcaaaccattcaaacctcctgtaaatcaggcctcttggttcctctccttctctccctcctgtgtctgttcatttggtcattttatttctgaatggtaattttcactgaggggtgggataggaaaataaaaagatatgaaagtcacattaggtagtgtagagaataattttaatagaagccacagtggagaatgcagatgtaattagcattaaaatgaaattctgaattgtcggtggattttagcttactttgctctccaaatcctttgttccctttaaaaactgagtacaattatgacaagcacctagcgaggctgtgcttcttttgtcctgctgaagaagccttgtctgaaccagggtggctgtgagcaggtcctgggccgagtaatggcatttaatgcatttgcctgttttagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaaggtacttctcattctcccacattctctaagtagcaagattagggagtctggttctgcagccaagactacggaaagcccaaagtctctctcaatttctaaaagaggtaacttcaggaactgtcatgtggaactgcttgatgtggcacctttcgtccgcccaagcccgaggactggtatcctctcacttctttgagtgtgggccctggatctaaaccgcccaggtccaaatcctgcctctatctcttcctagttgtgggaccttgaacaagatatctaaccacactgtactcgcttacctcaactgtaaaatgggatgatgttggtatcttccttgtggacgtgttttgaagatctaagaggtaatcttagttaagcagttagaacactggctggcccatagcaagagctccaaaaatgtcattgtcaccaccatcaccaccgtcattattgatgcttatcgattcacaggcattctttttcatgggacaaatgaacacacatcttatccagaaagtcacaggtcagcctttaaagaaagaactttatatctatgattttgtgaccctgagaatcctactgacataagatttttattagttggaaacatgagagattcttttgatctgcatcaaattatgtgctttgtatctccctaccagccccacattaggagctattctttccttttataagcagtacaaaaaaaataagattaagctgttctaagaattttcttttctatttttaaagccacgatgcagaagagaatagagaacactgataaatgtgcatgagtaatagctgaagagacaatttcccagtgagaataaaaagaaaaaggaaaaactacaatatgatttacttccagtaatcactaccacatttttactaagcatctattgtatattcaacatgtgctaggcattatgggggatacttataatgataatgatggctgtaatttattgagtatttaccatgtgcccggcactgtgctaagggccttgtcattatatgaattgaattcaatctcacagctaccctgagaagttgttattatacattggagaggaaaaggaactaagtttgagtactaagaatagaattaataataataataataataaacatttattgaggatatactccgtactaattgtttttcagcatttttacataattatgtcatttaatccagtgattctcaactggggtgagtttgccctgaggaacatttggcaatgtcttgagacatttggggttgtctcagctagaggggtgctaccggcttctagtgggtaaaagctaagcatgtgccaatgcacaggacaactcccgacaccaaagaattctccagtcccgaatgtcactagtactgagcttgagaaatcctaattgaatctttcccctaacttatgagttatatagccagcaagtagtggggcagggaatcatactactctaaactatctctaaactacctctcaagtatttaactactgctactctaaattacctctcaaggtagagtgaaaccccattataaagggcttgttatacagggctttaaaatctaggcaaggagtgtttgcttgatgttgcaggaaacaggaataaagatgagcaggcatgaggatgaccagaaaaaaacaaaaacaaaaacaaaaaaacctgtttaaggaggataccccatgtgacagcaggatggcttggagaggagggggcctacagtgaggaaggccagatacaagttggtgtcagtaatctgggtgaccaggtcctggatttggtgtagttgcaatggagagaaaatgatgggcacacacctacatatgcatgtgtgcacacaaacacacacacacacacacatcccagcagaacctagggtgagtgaaataagtagagaaaagaggcttattccaaggtttgggtctccccaagacccaaaataaataaaataaaagtgccattggaaggggtcactcgttttcaggaagatgaattaaattcaggacaggacaggacaagatgatttaaagtgacagcaagtggtaaaagagagggatgcagtgggaattaagcccacctggcctggtgccctggcagcccgctaaacatggcctggtgccccagcggcccactccagtctttaagccttgggtaaatctaacaaattttctagtttcagcaccttatgtcccaactgaagtagtaacatgtggcctgcccacctcacaaggtggttatgaggatcgaatgaggaaagagacaaattccttttcacagtataaaatgtgacctaagtgtgagtgcccattgccatcaatgggacaggaaatgaagatttgggttcctcatcataggagggatgataaaaattcaaagaattaatgagttctctcaaggagaaactttagatgcagaaggacagaagaccaagaaatcctactctctggggtaggacaagaaagagggaccagcaaaggagagaaaccaaaacatttattcttctagttcccattatctcatagaaatgaaaatagttggaaatacatttcagccaaggattcaggtctccactataaatgtaacatacaactgccttattttgaaaaggcattatgaagtcaccattccccccttcaaatctgcagacatgcacatccatcccagtggtgacatcactcttctctctcttcaacagattgactttgtggctcatgatgacattccgtattcctctgctggctctgatgatgtttacaagcacataaaggaagcaggtgaggcattcccctgtgctcacctgtcaaccacatcacaataatcaggtgcaataagagacatctgtctgccctgggacatctgcagtgtatacaaacagggagttacaactttaggtgtcccccaggcggcttctacaagccactgttagcatgtgctaaggctcagttatggcacagataccatttaggtatttatataggaatgaacctgagcaccaaagtgctcaacttcaggtctaaggcttaatttccggggtcatcagacgaaaagtgcaggaccccattacttaaatggcagccattttcctcattcataattaagtcttcacaatgagattattggatactcccaagaaatttccttccagaagcaggtagataactggctagttaataatctggactccttctgtccaaagttagtcctgccatatttctagtgtcatcttgtcacatgttagtaatattatcaggtaccatatgtggaggcaaaaaaaaatgggtaaatgttttaatggcttggcttattttctgctattttactatctaccatgcatctcatctataggcactgtaggtacacccatgcataccttcctacatacattaaaccataatctggcaggtgcagatactatagtgagttaccatatgcatagggatttcaagaagtctagtgctccctgcttatactagagccattgttgacatgtgccatcagagccatcttccccactcctggggaccaatgagactccactcagcttgctcccaccatttcccactcagcctgctgccactacagccttttcttggtactcatggaccttcagattcttgaggtaggatgggctcctaagggtcactgacccaggctcctatctccttcttggcatcattgccagctcctggcagaactgatgcttttacattccccatgatggagaactccctgccttgtgaggcagcccgttccatcttggatggttttggctgtcattgtttaatatatgaatcccctgagtgcatctataagccaggaattgtataagagaaaatgaataagacatagacctcacccttgagagagagcagagacagacataaataattacccaaaatataaccagcctgtggcagagtatatacaatacagcaggccagggcagcatgttcgaaggtgggactgtatgaagcacagcgtgtctggagaaaataaacatgttaatgtagtgtagggtgtgtggaggtgggaggcagagatggagactggcaggacaagctggttgaggcttgcttccatatgaagttacatggaaccaaatactgttctgaggcaggggagtgtcgtgatcaggtcttttgtgtgggaaggagcaactggggggccataagtggtttccataactaaacttaactaggaaaccccatttccacagctgacagaaaaaaaaaatacacttgacatgtgaaatcattcagactcttctaggtttgtacttagactgtgtagagtaaactttttgcctttttctcctgaggtgatctaagtttctggagcactctggcctggcatgggatggggatctttagttgtgaggtctcaagacctgcttagccatcagccccacttaccagacccctgtggcagcctctgagactctgtcatctccccactttggcctgagactgtcacctccccactttggcctgtcctggccacagcatctgccgcaggattcccttccctgtgctataggtgtgctgcccagcagtcatgctgatcttaaatcttggcttccttccatattcctctagagagtccccaggaaatttaaaaactgtcctccataatctactagagggcaagggaaaccaggcaatgtcagtaagccatgtcaggccctgtctgacctgcccgccatgttggcctctgtaaaactatttctttccaaaattcctggccataaacaaggtgccagtggccctgcactgagctttctaaaggggtctctttcctgcccctgcccctggtatttgaacctgagtcagagcaagggacagaccgcactcctgttctctcatttctgctgtccgcttcccaatccctctctgcactcctcccctcaactcccagaggtgcttttcttcttcctggagagcagaaaactgccccttaattaatttcatgccttcccagggttaatatacactccagggcttatagtcaaacattctgtaccctgagtctactcagcctctggttcttaatagttcaaaagacacttctgggatttataataccctttttatactcctcaaagcttggctcttcctagtggaattcttgcctttcttaactcttctttttaaatgagccttaaaaagagcctgttttagaagttgaaggctgaacacggcctcctgtactctcagcttcatctgcctccccctgaagtcatcgagttctcagtgtccatgggaacagggcctcaggacagacatgatccctagaaatgaaaacaacattggatactattttgaaaaattattgttacataaaatgtatgtattctccctgatggcatttttgttggttcacactccttgtgggccagcctgggaagctccatgccatcccctgcagggctggtggtggggactgtaccatcctcttaggaaggacttcctgagaagtcaagagcattggataatgggaggcctgacattctcaagtctcaatcttgtttgtgaggagttccaaggaaggaaacctcatacacttcggacttggaagtctgctctggaactggagaagaaactggcagatgcctcagttacatcaagatgggttacagcatggcgtgattaatatttatttatttacttactttacttacttaatttatgagacaagttctcactctttcacccaggctggagtacagtggtatgatcatagctcactgcaacctcgacctcctgggctcaggcgatcctcccacctcagcctctcaagtagctgggactacaggcacacaccaccatgcccagctaattttaaacttttttgtagagtttccctatgttgcccagactggtctcaaactcctgggctcaagtgatcctcccacctcggcctcccaaagtgctgggattatagctatgagccaccatgcctggcctgataaataccctttaaagtcattgtaagatctgaactatgagccagctgctcctttcctaaaattgccataaggatttgttatagaccagtgcttatgaaacttagatatgcctcagatcatctgtggaatcttgtgaaaattcagattcagattcagtaggtctggtggggccagagattcccatttctagtgagctctcaggttgttagatgctgtaggtccataggcctcacttacagtagcaaagatctggaccaggcattctcatccagctgagttatccccagggtttcttgaatcagtgtttcctgggggcagtagttccttggctaccttatagtgtataggaataagcatttggtggcagttttctttctgggtgagtggctgtcagtgagctaagaatatgttgctttcctgatttggggaataaaatgtcaagttccagttgtttaggtgtaggaacaagtccaacatttttctaactctagcaatccagcatccctattgttgcataagaaagtgactcctaaagttagtgacttaaaagagcctcttgatttcactcatgattttgtggggcaggattttagcagaggcttggctgggtagttcttgcttggggtctctcaaacagttgtaatcagatgttggtgggggctgtggtcatctgaaggctcgactgggctggggctcccaggtggtacacttacgtggctggccttggatgctggctatgatcatggcactcagttgcagttgccactggggcatacaggtggcctcttcatgttgcttgggcttctcacagcatggcagctgaaaggtaatatctagagagaaagcaatcttgacagaagccacaaggcttcttctgacttagtcgtggaagtcacacagagttacttttgccacgttcatttggtacaagcaagtcactgaggccagcccagattccaggggaagggaattgggccatctttaatgcaccacaatgccctttccaaattgaatagtcaggtagcattttacttgccctagtagcacaggctaagactcgatgtaacttttcctatgtgcaaggacccttccttgtgctccatcaaatctgctctgctgattccttagcaggagggagaatcacagtaatgatctatttgggacccaggtagagaaggccagaattcatcatgggagaaagatgctcagaaatggcctcagcatccatatttggctttcatactcaaatcatggcttattttgaaagtcaaaagtctctttaaatgaaaccagagatatcaagggcatgacttaagctttacaacactctgctctgcttgtcagaactatgtgtcaaaatcctctagcaaagctggatgaaaagatggagcttaaattaaatagactgtaaggtccacattactcatcaccattctaatattgcctactactgttgaaagtttccttcattaacatgtgctttgctgcttcttaaaatagctccataaccaaatgccgcaattctgaaaagcatgataaaaaaggttctctgatcatgctcattaccgaatatttttagcagagcaataattaggatttgaaggaagccgggtatctcattatgtcaacagaggacttggcttctttcagagacctacctcccaaccagccaaagcaaatctctccctaagccaaatctactttcagttactcaaacacagagacttcaccttctggcttcaaagaaagggtaagctcatggcatcaatgtcttacatgacttgctaaaatccattagtcactagagaatcgtcttattatttcagcaggaggggtgtgggtaaaatatctgcctgctgaaagatgggatggatttctcaccagaatgttccccactgttcccacaaaggtggggatgtcgtctgagggttcccccacccaccagagcctcctgcacagctgggtcaatttgggtgctatttatgttcgtgtgtttagatggttacatcttctgccttccatttggttttccgtgttagattcttccctcctagaaagtgataaaagaagtgtttggcctagtggcaaaccccaactgtcctctgaccatggaacataagaaactggatgttttgtctctaacatcagcagtgccactctgctactgatactataaatgtgcaaatgacatcaaaagaaagctccaaagagacaccctcattggggctgcaagatggaaacattcagagagaactgggtttggaagggcacttagagatcaatattcatctagtcattcattcaagaaatattcctatggtgcctgtttgtcacccagtgctgagaatgtagaagaggacgagaaaggcatgatcccttccctagtgtagcttatagtcaacaagacagttgttgaacaagttattttataaagatcttgctgtatttggagggaaggggagtggtccatgggaaggaacaacacaccagaagacctagtctgagggttgagatatttgcttgaggaagtgacactaaagctgaagcccagtggatgcccaggagttaaccaggtaaagattgtgtctgtggcagagtgaggggaggggaaccaaccctttcaggacactgaagaaacccagcatggctgggctgaggcagggtcagcctactgcacagctccacagaatacaacagcagtccccccctgcagttgtatagcaggggggccttggtttagggagtgaaagggagagggtctgagataaaattggagagaagcacagggaagagacatgcaagctactgcacagccaagttaaggatttgactctgaatccagagaagagcagaaagccagtggagggttttgagcagacctctgacttgcatttagtaagaatgctctgtagaacttgctctctgggttgaggcagacaaaaatgacattgctggagactggttttgaggttcttgctgtgatctttgaccaagatggtgttgaattggtttaggatggatgaaagtgagtgaattagggaaacatttaagaagtagattgggaacttggttggatgtgggaagtgagagagaaagaaatggcacagatgagtcccaggtcatcatgtccaatcacctttttctcagctgaggagactacagttaagtaactcgccttcagagggtttgagtgacttgcccacgtctacaaaccaagaacccagtgcccttgtccccaggctttgtccatactgtcccatgcctgatgcctctgactgagttgccgtaatgatatgggatagaaagatctcagttgccaacaacatgtcatttcagttcacaacagaagtgtaagcataaacctgattcttgcctttgttaatatttgtgacctctttatagctctatatctgttgatatacccacatttatctttgaagactttaaggaagttctattagaacttggcatcctctgtgcttgtttattttttactcagccccacatattctagatgaaagggcctttgagtggtgaaactaccatgtacagtagactgttcttaggaagataaatcatctaaccatccctacaggcatgcctttagatcagagacgacacaaatagtacactttttcttcttttcctttagtataatgtgagcagacttccttggagatgaagcagagttgctgtgatctaattcattgactcagttgttagtcttcatttactttctcactcaatttccatttattgagcaccttccatgtgctagacacaggggctgaggtgggtgctggggatgcaaagacagttaaggcactatcagtgctttcaaaatgttcattttctacatggagacaaatatttaattttttttgtttgtttgagacaaggtcaggctggagtgcagtggcgcagtcactgctcacagcagccttgatcttggactcaagtgatcctctcactttagtctccgaagtagctgggaccacaggcgtgcaccaccacacccagctaacttttgtattttttgtaaagacagggttttgccatgttgcccaggctgatctcgaactcctggactcaaatggtctgcctgcctcggccttcgaaagtactgggattataggcatgagccaccatggctggcccaatatttttgttaatgaaagataagttaggttctgaatgttgtggattctacctgatgacgtcagaaaagacttcccagaggcataaccttgaagctggactttgcaggatgaggaagagctttgcagttaatatgagcagggagggggtatccagggcagaaaggaaaggctcagcatggataaacagcaggggccaggcaagtacatggtatgtcctggaaacaggtctgggatgatgaacatgtagcatttaaggtagagaggaattccacggaactgagggtggaagagtcacttggggccagacgtaaagtcttcattggcatacccaggagctccaactttgtcctgtaaagggggaccattaaaggagatgggtcaactgaggtgatcttaatttttcctctatccgctcttttctacttgaacagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgtaagcatgccacctcaaaccctctgaagaccaccatgccacaccaccaccaccagtgctgctgtttattgagcacttactaagtgctatgcagtgttctccctctctctctctcttttttttttttttgtgtagagatggggtctcactgtgtataatattttaagtttgatttaacttgtttttttttttttgagacagggtctcactatgttgtccagactggtcttgaactcctgggctcaagcgatcctcctgcctcagcctcctgagtagctgggattacaggcatttgccaccatgcctgtgcagtgtccttaacgctttgtatttattttctcatttaacccacacaataacccatgatgtattattatccccattttacagatgacaaaaccagtatctacaggggtaacataaattaaccaaagaacacaggtagtgagcttcacattttataaaggtgcttccttgcttccctcctcttaccccaaactctctctttagagtttttagacttgattgaagggtttctgggagatctgccccttgtaaaaggcaagagttatcttctgctgaaaggaaagggaggagggaagaggcaatgaaagctaaacccagagaaacttttttattctaacgttttaaaattttcatttgattaaggccttacagatgctcattagaaaccttaatggccatttttcattgtccaaagaaattacagctgcttaaataaagcctaaagtctttggcttccttttgtagttctaccatattgttcccacaggactgctgttagtttaataatagagcaactgttaaaacaatatttcagttctggcatacatgtgcagaacatgcaggtttgttacataggtatacacgtgccatggtggtttgctgcacccatcaacccgtcatctacattaggtatttctcctaatgctatccctcccctagccccccaccccctgacaggccctggtgtgtgatgttcccctccctatgtccatgtgttctcattgttcagctcccacttatgagtgagaacacgcggtgtttggttttctgttcctgtgttagtttgctgagaatgatggtttccagcttcatccacgtccctgcaaaggacatgaactcatccttttttatgtatgcatagtattccatggtgtatatgtgccacattttctttatccagtctatcattgatgggcgtttgggttggttccaagtctttgctattgtgaatagtgctgcaacaaacatacatgtgcatgtgtctttatagtagacaaagaacattaacagtgacttagattccctcaggatgccatttttatataataataataataaaaacaatctttaaaataagcaaaacaagctgttaaaaagcaaagagggcagcccagttgctggagatgatgttagtgattctgagcaactgtatttgcctgggctgtgaggtgccgatatctttgattaaaataagaaccctccgtacatacagaattctaacccccaaaatagacgctgtattttcaaaggatgattcatcttcaaagctagatacttaaaattacatgcagctataattatccaatagctcacacaattgatcattggtaccttcaaaataggaggggctcattaattgtgaatcgttgatcatgagttgtcctcacaaggcagggagtgttgagagtctaggctctgtaacttcatataagccgggcaacaaaatgtcaggaaatgtcggaaaatgtcaggtttgagtggcactggaacaagtggctgaacataattcagtcaaagtgattatttagtatctgatagagaataaagccctggttatttcaataaattaaactgtctgttctttcaaattgaattcggtcaaccatccaaacatgtcaagccattttcaaaagttattgctcactctctttaaacggcgtttagataagccacttagctcaaggaaccgtgcaggcagttcggatgcactcactgccttcctgtgacgacaaacctggctgcagttcagagatgaaatctaatgtgttgcatgggcgtgtagacaaatcacggaacctcagaggtgacagggacctgatgccagtcagtcacccagtccaagtccctcaatttagagatgaggaacgctgagcccagaaagggagcctggccaaggtccttcaggtcagggagaggtagaggcagcagcaactccccagtctcatgactcccagcccagtgctcattcagctattctgtgctgccctgagagccatgtatagtaactatttccagtgcagaatgaactgtggaaaagaatgatataaaggcaacagctaacatttgccaagaactcatcatatgctcatctaagtgttttacttggattatctcatttaatcctcatgatgggcctacaagggtgggtaggatgactatgtccaacatagaaatgaggaaacagaggcccagagaggttgaacaactcacctaaggtcacctagtaagtaacggaagacagagtgacctcccatagcacatatatgtatatatatagctctcagtagcaacacacatagctcatgccccagcctgaggctgcaggaaggtttggaaggtcgaaatcaaggactctttacccagttttgcaatattccaggtgtttcaaaaacttccgaaacacaggccaggcacagtggctcatgcatgtaatcccagcactttggaaggccgaggcgagtggatcacttcaggtcaggagttcaagaccagcctggccaacatggtgaaaccccgtccctactaaaaatacaaaaaattagccggatgtggtggtgtgtgcctgttattccagctactcaggaggctgaggcatgagaatcgcttgaacccgggaggcagaggttgcagtgagctgagatcatgccattgcactccagcctgggcaacagagcgagactccatttcaaaaaaataaaattctgaaacacaaaatgaactttagtcccacatagtaaagaaaaatgataagccttacccctttaggagaaacatcatgatttcatgggggaagagccacatgttattttcatggttttaatactgctctcatcaggtaacacagacaaatgcctctgccacttaatactaatgaaacagccaacatacactgagcatttactaaatgctggcctttgtgccaagcactttgcatgcattgtcacagcaaccctaaggtagggatgattattatccccaatttacagatgagaagactgaggtttagaggtgatatgtgacttgcccagcatacgatggtttccaagcacataagtagacattgctgcagaaagactataagaagaacaaaatctgagtctagagaaactatcagcacaaaagctttcatcaccaccaaggaaatcaatacagttaaattagcatagtggaaaatattacagtggaaattttagtataacacataggttctaaggcccagttaatggcccacttatttcaagcaatattgttttaaccatatcccagtaaaacagcgaactcaggcagcttctgaatagtcattgtgtgcacaattcatacttttgtctaagtcccagcagaattgaatggggttatttgcccaatatctatgcacaacaaaagacaactgtgtgttttttattctcctcttatataagtgaatccaactcaaagacatttaaaagaaagaagatattaaaaccacttgtagttccctttacatatccaaatggattaatggcagatgacttttcttacaagagatgtgcctttccatcaacctagcccttgggaaatggcaacatcttgactcttcaggttaggaacaaatacaaattggaataaaatatgaactttaatgtgaatgattgatctctctcatgtcctcttggataaatctgtttttttttttcctgtaaactttcaccaggagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatgggtatgtaatgatttcactttaccccacaatgatgagtgttttcagtttatcctcctttttatggagccactcaagggtgccccttatctcagatccactgcatgccctctactttaggcatcagcctgaatgacttcaagtccatgtcacttccttactgagtttctgctttactcgtcaatatggcacccagtagcacacaaagccacgtctggtttcagtttctagttcttatccagagcttggaagccatctggtgatcacttgagtgtctcttacttcaggagttgatgctgtcgctcatctcagtctcccagttggggatgatgaaactttgggagtacagatgaagtgggctagtggcagcacggagcttgtgttacaagacatggatcatgggatcttggatcaactactggcatttatgttttggggaggagaatccaaagaaatgtactctgtcagtcagtttttcttgtgaggagccctcctcttttactggttgcaagacagagagagaagaagtaggagtttgccctgcatctgtgcccatcgtgccctgattttcccctggtttttcatgacacgcaagtgttgggataaggcacaacagtctttggggactgaggacatgatctgaatcttaaaactgagaggaaatgtagagggtctccttgcctaaaatctgaacaactttgaatgataactatggaaagggaaaagaaaattctggaaacctccactggtactttattggtatttctattgtgcatgcccttcccaagtaaataccagtattatcaggagagttgatgaggggtctgtaaaagagattcgaaaagtttactttagagacgctaaagggttgacgagggttgtatgaaagagatactaaaaacaaaatttcctcctacaacaaaaagaaaaaattccatttgatttctctgattttaagtagcctggatttcctattataatatgagaagtctctaccaaaatccactttgacttaattattttattgacgggttgtcactgctacctctgcttgtttgagctcattcattataggattatctaaaagtgaaacactcaattagtaatagaaaaagaacaatgtttgggaagttgggagagatgctttgcttaacacctggcagcctctaagtgattatagacgtgggtgttataggccaaccatgtcctatcggctgagtctgagaggggtgaaaggtttacaaggactgcatgagccttcaaagactcctagaaagagctggcaagagtggaggagccaagggctgggctccttttcattttccccaggcctgttaaaaatttcagctcagataagttaattcctggtacatttcttaatgtttttgtctatgcatggcactatgcataaagaagaacataaaaacagacaaagtacagaccctgttctctcgtctctatgacatatggtatgaaattttctatttaatctagtgtgtattttaatagttcacattttcacaactaatttccaggctctaaagaaacaactagtggtttttaatgaaaccatgtaggtgttcattcgtttacagggattcagaaacctgtctctgctgataagagttggtatagtaactcaagagggtggatgttttctccacttggagtgagtaaaggcagggaaaaaatgtaatttcccactttgggaggccgaagtggatggattacctgaggtcaggagtttgaggctagcctggccaacatggtgaaaccccgtatctactaaaaatacaaaaaaattagccaggtgtggtggcgcgtatctgtagtcccagctactcaggaggctgaggcaggagaattgcttgagcccaggaggcggaggttgcagtgagcccagatcatgccaccacactccagcctgggtgacagagagagactctgtctcaaaaatatatatatatatgtgtgtgtgtgtgtgtgtgtgtgtgtgtgtatgtgtgtgtatatgtgtgggtatatatgtgtgtgtatatgtgtgtatatctatgtgtgtgtatttctgtgtgtgaatatatgtgtgtgtatatgtatatatgtgtgtatgtgtgtgtatatgtgtgtatatatgtgtgtgtttgtatatatgtgtatatatatgtgtgtgtatgtgtgtatatgtgtgtgtgtgtatatatatatatatatataatttgatgaaaactttatagaccttagtcatttcaggctcccagtgaaggtgaaatagtagctggaattgttcttgggagtctgatgacagcaagccaaggtgatttttaagaaatgaaacccagtttagagactggaggtttttctttttaaaacttgctattagtgtcaaaactgttattaccattaatttaccatatcagccagactaagacattactttttttctgttgacgttaaaaatacaggaatagttacaaggatgttaaacgccaagataagtaatttgcttttcatgaatatgctattattataataattccttatttgtgaatttgggactggaactcatttcttaaaatagaagatctgtattaccggcaaatacagtactgttacaaacaacccaaacttggaaaggcacaaaatagaaggatttaagatacaagttctggtacaatgagataggtatgcagcatagtatgtaacttatagtgggtattccacaaatgtttctgggttaaatgaatgtatgaatgaatggatgtatgaagaagacctattcacagaaccttccagcatctgcaaaggatttgtgtgctaaagcctaaatcccccaccccatatacgtgtgtgtgtgtgtgtgtgtgtgcgcgcgcgtgtgtgtatgtagacagatagatagatgataagcagatagatagccttagccttttattgcttatggtgctaggtacaggactttattacaacttggtgtttggtggatcaaattcagtacacagacgtggtgtgctttgcccttaacaatgttttaaaatttattttagggaaggcatgagctcttgtttgccatagtcacaccttgctccgctgctcctttcccctcccctaacctgactcacacatttatgcagcccatctggccccagggaatatttgaatttgctccttgtggtatagtcttttttaaagcagggtctcactctgttgcccaggctggagtgcagtggcatgatcatgactcactgtaacctcaaatttctgggctcaagcaatcctcccacctcagcctcccagatagatgggactacaggtgtgtgccaccatgcccagctaatttttaaattttttgtagagatacagtcttactctgttgcccagactggagtgaagtggtgtgatcatgactcactgtaacctcgaactcctgggctcaagagaccctcttgccttggcccaccaaggtgctgggattacaggcatgagccactgggattacagtgcctggccatagtcttttaagtctccccaagtgacctcatatttgacattaaggatgccaatataaaattgaagcccttacatgctatctctgagtagaaagtagtgatgatgatgatgatgatgatgatgatagtaaataagaaggtgatgatgatgatattgtctaaaagttgtatggcaggttgaattcttttttcaatgtccttgcacatttattctacccattttatttacttatttatttttatttatttatttatttttgagatggagtctcactcactctgtcaccccaggtggaatgcaatggcgcgatctcggttcactgcaatctctgcctcccgggctcaagtgattctcctgcctcagcctcccgagtagctaggactacaggcatgtgctaccacgcccggctaatttttgtatttttagtagagacggggtttcaccatgttggccaggctggtctcaaactcctgacctcaagtgatccacccaccttggcctcccgccacccattttaatcacacaggaaggtacattttatagataaatatatagatatagacaaaggcctacaaaattatacgatgaaactttcccgtggtctcacaggagttggtaggcggtaggatggagcctggggctagcctctttctcctggtcatgtctgtatccttcaccataggaatgtccacatgatgcagtcattttgcttcattttcctttggtcggggtgtgtcactgtagagaaactgaggtctaccaacatccctctaaggcctttgacaatgccagttgccagaattgtgcttgagaccaggccatctagatttatgataggcactctcagccctccactgtactgctgtctctaggctttctcagcaaacagaaagtgtggtatccatgcctattagttagcttttggtggtaacaaattacctcaaaacttggtggcttaaaacgacaaacatttattatctcacagtctctgagggtcaggaaccaggaagcagcccagctggatggttctgactcggtctttcatgaagttgcagttaagacgtcagctggtggccaggcacagtagttcacgcctgtaatcccagtactttgggaggccgaagcaggtgaatcacctgaggtcaagagttcaagaccagcctggccaacgtggtgaaaccccatctttactaaaaatataaaaattagccaggcatggtggtacacggctgtaatcccagctactcgggaggctgaggcaggagaatcacttgaacccgggaggcggaggttgcaatgactcgagattgcaccactgcactccagcctggggaacaagagtgaaactccgcctcaaaaaacaaatttgtgacaaatatattcatatattcataaacataaaatgtaccattttaaccttttttttttttttttttctgagactgagccttgctcttgtctcccaggctggagtgcgatggtgtgatctcagctcactgcaacctccacctcccaggttcaaccgattctcctgtctcagcctcccgagtagctggaattacaggcgtgcgccaccaccatgcccagctaatttttatatttttagtagaggtggggttttgccatgttggccaggctggtctcgaactcctgacctcaggtgatctgcctgcctcagcctcccgaagtgctgggattacaggcatgagccactgtgcccggcccattttaaccattttaagtgcacaatttagtgggattaaatggttgcattcacattgtcctgcaaccatcaccaccatccatctccagaacttcttcatcatcccaaacagaaactgtaaccattaaacaagagctccctatccccttctgcccccagcccctggcagccagccttctacttcctgcctctataaatttgaccactctatgaacctcatatgagtggaatcatacagcatttgtccttttgtggctggcatatttcacttagcatgatgtcttcagggttcatccatgttgtagcatgtgtcagaattttctttcttttgaaggctgaatgatattccactttatgtgtacatcacatcttttttatccattgttccattgatggatgtttgggttgatgtgaacattggtgtttgagttctgctttcaattcttttgggtatatactgagaaatagaattgctggacaacatggtaattctatgtttaatttttttgaggagccgccttactgttttccatagtggccgcacagttttacatttccacgagcaatgcacagggatctaatttctccacatcctcaccaacacttgttattttctgtttctttgtttttttttttaaataatcgtcctaattttaggcactgctaatttttaagatttttgattttgagaaaagagctacaaaatatagtttgtggatctgcattagatttcccacctgagactttgacagtttaaaaaattttatctttttttaaaaaaagattgttgttgttgttgtttttaagacagagtcttgctctgtcacccaggctggagtgcaatggtgcaatctcggctcactgcaactttgcctcctgggttcaagtgattcttctgcttcagcctcctgagtagctgggactacaggcatatgccaccatgcccgactaatttttgtatttttagtagagatgggattttaccatgttggccaggctggtctcaaactcctgacctgacctcaagtgatccacccacctcggcctcccatagtgctggggttataggcatgagccactgcgcccggccccaaatttttatccttaaacaaaggtacaagtaaaatgtgaataaacatgaaaagtttcttattatgcaactggctaattacaagagaggtggtcatgagcagggggtcactctctgggtaggtgacttaaggcaagttcatttgcctctctgggacttagtcatagcatcagtaaatggggaaagtaagcatagctgccacatagggctgttgcgaggattacattggttcatacttcatttttaaaatctatattttttgagacagggtcttcctttgttgcccaggctagagtgtagtggcacaatcatgggtcactgcaaccttgaactcccaggctcaagcgatcttcccacctaggccctctccccactcaacctgagtacctgggactacaggtgcataccaccatgcccagctaagtttttcaaaattgtttgtagagatgggggtctcacactatgttgcccaggctgatctcgaactcctggactcaagcggtcctcccacttcagcctcccaaagtgttgggattataggcatgagccatcgcacccagactggctcacacttcaacgcccttagagcagtgcctggcacctgtgtcgggcaccgtgtaagggttagttgttattgatttggccagaactgaagcatgggcccttttctctccttgagtttcatcttgcttacccaagggccaaaccaaaccagatcgtaccaggaactttatcatttcttttcggcagataaaccagaatagatctgaaatactgaaacctttaaaggcatttgtcaagacatttattgccccactagatgttaagtacttctggtttttgtttgtttgtttttgtttttttgagatggagtctcgctctgttgcccaggctggagtgcaatggcatgatctcgcctcactgcaacctccgcctcctgggttcaagtgattctcctgcctcagcctcctgagtagctaggattacagacacccgccaccatgcccaggtaatttttgtatttttagtagagacagggtttcaccatgttagccaggttgctctcgaactcttgaactcatgatccgcccgcctcagcctcctaaagtgctggaataacaggcatgagccaccgcacccggccgatgttaagtacttcttaaaagggaaaacttcataggagagaaatagaaaactactttcgtatggacaggactataaatgggattattttcttgagggaaaacattataaatggaaacctcttaatacagtgagagactgaatttaaatacctttactcttggaaaatgccatgcatactcttccttatttgttatatttctaaagtgcttttcttcccaggaagctcattacaaactgtctcctgactgtattgaattccgctcctttgcaagggaaccacccttcaaaatgcaccagaaacagatcagagagctggcaaattgaggctgggagttattttgcatggatattgcattttatgaagtgcgacaccgttgtttatcattaaagattcaagttctttcatcccctcaggcagaatgttctcagctatgagcttgattcaaactatagtagacaagtcgtagatttcttagaaagtgaacttctaatggaaatcctgacaatccattaacagcaggagggctaatggctgccacagaaaatatacttaaagattacagtaataaaaacacatattttaaagtgcctgctagaagttcaagaatgtttttaaatgttgctgttaataatagaccaccaaatccttatagcatttgaatttgcctcataaatgggtttaatctaagggagtgctgttgtactgcaccttttttttctgtttgactttgaggggggcttgatatcttttggcagaattatcaatgccttaatggaaggtaaataattggtatattagcagacgtgtggaattttaaatctggaaaagacctgagcaatcagccatcatctgttattatatctgctagaggaaacttgggactctacaaagtaacgggctagagcttagaaaggaaaaatgagtgttgggggcaggcagtgctattggtgatgcgcctgtggccttaatagttccttaccaatgtcattattgtaacacctgcccttccgcctgatctccttgcatgggttacatgagttctttcttcctactgtgatgcttttttatgataaaagtaatatatattcattatataaccattagaaagtaaagaagggactgaaaatcactcgcagtctcatcatccagagcagtctctctgttagcatttcgggttatcactcccatctgtttcccatctccgtatatgtacattccttctacaaacttgagatcatgcagaacatagtgttctaaaatcattttggctttgcagttgctcatgagtgttttctcacatgatgaaatattatttaagaacctgattctcctcatctgcttattatatcatcttggagttgtacaggtttttctaacctagttagagaatttgcagtgttgtgtgttatacattgcattgaatgtccatcatacacaataaagatttacttacatctctgattatctcctcagaaaatagaagtttttgcatctattgccaaattccccatcagaaaggcattgctgttttatcctcttaccagcagtaacatgaaggtagcccttttcctgagccctcactagctgtaacaaatttttaaaactttagcaatctgatatataaaatgtatcttatttcagccatttgcatttgttcgactactagtgatgctgaacagtttttctagctcatttacaaatttctcttgtgacttgtctatacaggccatatgttcatttttctactaagcttttcaccttcttctttttgatttataagctctgtctatataccgagatctatcatttgtaggtaaactttgcaaaaaattccactattttttgccttttttcttatttcatggtgttttttttttttttgaggtacagaagttttaaaattttgtgtagtcaaatgtcaatgttttcctttatggtttctttctttgcttttatgctgacacccaaaggtatttctaaaacacagatctgatcagactccgcccttgattaaaatctttctgggtttcttgagtaggaaatccagtctccttgtggtgctctaggtccagaccattgccaccccatgggcatttggggttctggccacactaagcaacttagacttagtactccttacttagcatgctctgtttagaaaggccatcctctactagcccccatggacccactccccatctccacccacctcttcctgggcattatcaaagacccagctgagacatgaccacctcttctaccctcttcttcccccccttcctcctgtgtagcacctggtccccagaagatctctgtaacggtttgtaaaatgaataacccaaaggacaagcaaagcctaagatggtaaataggagaattggctttcagggccagttttgtatcaaaggattgaactgagtggctgggggctaaggctcaaatgtgagcaattgaaagaccccaggcagcacaggcaggatgctcaggagttggtgggatgcagcgtctgggaggctgagcagcaggcagcaggcacagtaggctgggagcactgggggcccagtggggagcttcagggaagggctcaattctgaaagcacccagcaaccatcacatgaggtcccaaactggtaaactgatcttaaccaccgaaacctcctcccaccccacagtcttccccaaactgggaaatggcatcactgctttccaatttcttggacccgagactgcagtcacttgattcccgttcctcccacaccccatgtcccatctgtcagtgagtcccgttggctctaccatgaaaacatagccagaccacatactgtaggattctattttgatgacattctagaaaaggcacaactgtagggacagaaaacacatctgttgccagtggctgggggaggggagactccaaagggtcatgagggaatttgggagctgatgggaccctcctatgccttgattgcagtggtggtcactcaactgtatgcattgtcaaaactcacagaactggccgggcgcggtggctcacacctgtaatcccagcactttgggaggccaaagtgggcggatcacgaggtcaggagatcgagaccagcctggctaacacggtgaaaccccgtctctactaaaaatacaaaaaattagccaggccgggtggcgggcgcctgtagtcccagctactggggaggctgaggcaggagaatggcgtgaacccgggaggcggagcttgcagtgaaccgagatcgcgccactgcactccagcaagactctgtcaaaaaaaaacaaaaaacaaaaaaacaaaaaaacaaaacaaaacaaaaacttaacagaactgtacactaaaaagggtgagtttattatacctcagtaaaaatatgggggaaaatatactaggaatcctgccatttttcagcacactgccatcatcccgggccgggccaggctccatcaccatcttggatttttttttttttctcttgagacggagtctcactctgttgcccaggctggagtacagtggcgccatctcggctcactgcaacctccaccttctgggttcaagtggttctcctgcgtcagcctccccagaagcttggattacaggtgcccaccaccctgcccagctaattttttgtattttagtagagaaagggtttcaccatgttggccaggatggtctcgatctcctgacctcaaatgatctgcccgacttggccttcaaaagtgctgggattgcaggcataagccaccgcgcctggccttggattcttattgcaacgggctcataagtgggctccctgttcctgcccccgcctcactgccatctgttcccaacacagcagtcagaatggtcttttgaaaacaagcagcagattgttaatcctttgctcagaattctccagaggtttctcttctcagaggagactgtacgtgaaactgccgcctgatatgtctctggcctgatctcccgcagtgcctccccctctcccttccccaccagctcgctccatactgccacgatggcctcctcctctcctgggacctgttgcatgggtcccctcagactgaaaggcagagttctcacaatggctgccaaggccctccatggcacagccctctgtgccttctctggcaacctcttcccaaccgcctccctcagctcctccccatctatcagccctcaaggcagccgcggtgccctgcctgcgcttcctgggtgtgcgttccatgctcctttcttggggtgctctgtctggagtgcgctgccctctgatttccattcacctggtccctccccttatctcttccaggttcttcactcaagaagcgttttctcagtggggccttccccgagcaccctgtttgcaatcgcagctgccctgctcccagccccacttgctatcctctcgccctctttttctcacagaccacagatccatctgacataccatattttgtttattgtgtgattcctcctcatatctgtgagggtatgaggtcaggggttttgttttctgccacccctccagtccgtaggtcatgactacttgcctggctagtcagagacactcagttaaattttgtagatggaagaaaaaaaaggaagaaggaaagagtgttaagaaccagtggtagctgggcatggtggctcacgcctgtaatcccagcactttaggaggctgaggtgggtggatcacctgaggtcaggagttcaagaccagcctgaccaacatggtgaaaccccgtttctactaaaaatacaaaattagccgggcatggtggcgggcacctgtaatcccagctacttgggaggctgaggcaggagaattgcttgaacctgggaggctgaggttgcagtgagccaagatcatgccactgcactccagcttgggtgacagagcgagactctgtctcaaaaaaaaaaaaaaagagaaaaaaagaaccagtggtgactgtaatcttctgtcactacccctgaatatcactcggttccttactatacatagtcttggacaacacgggatgtggtatgagtgtaggtttgtgggctcaggagttttggggtagtggctctcctgcctgccttacctttttgttttgctgctgcctcagattgcaaagttaacagatgccttctctccaatttatctttagaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaat

SEQ ID NO: 4444 - DNA, 85316 bp, human
gcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactggtaagtaaagacaaaggatggaaatgtatgcgtggctatggcataaaagagttccttatgcgcccgcagccagcgaggaaaacgatgcttagaggattttcatgtaaatgagaagagcgctaccgcctaatccttctcagctgtttatacttagcttctataccgggcgctgctctcagtttacaaagcgttattgtattggctgggtaggaaacgggctgcttgggatatgctgtgtttttgtgcttcgggaggaggggagggcctttttccttttaggtgtgttcttgtctgaaggtaaaaaaatcctacagtgcaattttaaaatggtattctctttaccaagctcgggaagagtcccttgttaagttttaaattctagctaaggaatgcttcgttcctcaactgattttggtgcctaatgccaatttggggggaaaaaaatggaaacatggaagcaaaacttccccatccgtttgaaaatgttcaaaataaataaataaataaatacataggagtccctcaatgatttagttagaaataatacgcatttaaaacgaattgtaaaacatttccagagtgtgctgtgagggtttctcttcaggtagtggaaacctggggagctacatttatttagaaaggggttgcatgcctttaagaatgaaagtgtggaaacggggtactgagagcgtccttccgcctccgtaactgcaccgtaactgctctcccaaatttggtcgtctctctatccctggtcatgatcttttaggtagatgtgaaacttcgttcccaaccacctcagcatgtgtcctcaaggaatcaaaaacacgcatgggtggtgggttttctgtggtccgaagtcttgtggaacttggggagacctctctttgagtcccccaatccaaaagacacactagttaaagctatcctttcctttagcgatttccctcaagttaaaaggtggaatattttgattggctgtggagtttgaccctgggaagagttttttaaaaaaggattttgtgatgtagcattttctgtgaacctgcaaaattagggctcgcagatgagaaggccaacccatcataaaactgttatttcttaataagagttaataagggttcaaaggaggcttagaacaacttcctaaaaagcacaaatacagaggaagttatattagagccctgtgggcttttttcccctatgcttctatttttaaaaatgttttctcttagggcagtttaatagtaactgtgccctagcactttagccacttactgaatgacatacacagtgcagtgtctatgttctcatgagatacaaaccatcccaataagtttgttactaagggattcctttgagtcactaaacaacttatggtttagcataaaggaaaatgaccactaaaagcatattacaagattatcatatgcacatatacatatatacacataaatagagagagagactcactctgttttccaggctggcctcaaacttgaactcctggactcaagtgatcctcctgcctcagcctcccaagtagctgggattacaggcttgtgccacagcactggaccaatatatatatgtgtgtatatatatatatgtatatacacacatatatacatatatacacacatatgtatatatatttgtgcccatgcttacccaaaaatatattttttaaagtaaccacaatcttcaaatttgcatcacataccttcctgacagaggtaaagggcagaggagagaaaggcggcatccagctccagtttgtgcatcatttcagtctcttttgcctactatttttccttccatttttacctcttagctattctgcttcttgattgcttctgcctgagggagatgggcagagaaaattaagggaaagaagaaagttcaagttactttcttgtttttttaagatggagtctcactatgtcctccaggctagagtgcagtggcctgatcttggctcaccacaacctccacctcccaggttcaagcgattctcctgcctcagcctcctgagtagctgggattacaggtgggcagcaccatgcctggctaatatttttttgtatttttggtagagacggggttttgccatgttggccaggctggtctcgaactcctgccctcaggtgatccgcccaccttggcctccaaagtattgggattacaggtgtgacccactgcacctggccaagttactttccactttcactcgtgacagcttattccaggtggtaactcacaagaaccacgcaaagctggcaatgtgctctacaccctcacctcccacccattgtagaaataaggaaactgaggttcagagagggtaagtgacttgcccaagggtcacactgctttgaagggggcagagctgggatttgaacccagagctctacaccggaaaagtggaagatctttcttctataacatactcataagtgagatacattcccttcccatctttttggcagttctggtttcgtgtgtgtgtgtgtgtgtgtgtgtgtgtgtgtgtgtgtgtatcatgcacatgcataggtatgatacagatgtacataagttgaactgttgaagcacctgctttgatttacttatgatacaaaattttccacgttgttcatcattgtcatgggctactgaaatttgactctgtttaaacaggggcttgcaaccaatttataaaacactactaaaattttcaaattgccttctctcttattagctaactttgatcactgtagggttatattctaaatttagatttatactttatagcctaactttcctttgctaatgatcttactttaataactaaggcacatgctaactacttaataaaaaagtttgttgatgaagagagtgagcagcaagtgaaaacatgaaattagcatttctttctctggtttttagtagtttctgttgatcttgtagctttgctagtgtcttcatatttcaaattgtataaattctgcatttctcccagcacccaggcatatagctccaaattgtatgtgggtcactgacaccacagccatcaacagagtgtggctactgagttgcttaactaactatggaaagtgtatgaaatatttgcagggggcctgtttaggattgaagctccacacttggattctccttcagagggcaggctccttctcctagttgctgaaatgaagtggggagctggcatacgtgagtgaataaatagactttaaagcagtctatattttagatccctgtaagtaacaaattgataataatattgcagatatgattgaattatatttcaaggggaagttcttctgccaggaaaacttgtagtttctctacctgccttattcttcattagaggaaaatataagaaaggagacgattaaatagaatgcagtaactctgataaagaaattagaaaagaaataacaaaagcattacctaggttttatgatagagcctatattttaggaatataatcttactactcttaccattttaccatggtgctctgatttgagatgcttctgagaactctttacattgttacaatgtttactcttgattcttgacttgttttcagttctttactattttcctgattaaacatgatgcaaggtgactcatcagcttgactgtcaagatgagaaactgagtggccttgggtgatatgatgtaatagcccttcttggaaatctaactcctgagatacaaggactcctctgagcaaggactgtgtcctcatatcttcccagccctcagattatgcctagaaagatcctctgggctcagcaggtgtcccagaagccctttctaacaaggcccagccaccctgaaagttgtctgcttgagaatttggttaatgaccttggacaagttcttctaggggtgcattctgttgtcagaaggaattgtaattctagactgcaatagtcacttccatgaagatggatatactatggatcaactgagaaggccttggaaataaaaaagggttggttcaacatgccacattagcaggaggagttcatttcgggttttacttcaaagtggagcagtgccaagagactgctgtcttgcagaaggtgcattatgtcagtttggaggtagcatgctcatctgctagtattcaaaaagatgaccagatttccagagacatcaatggcttcctttgctaatattgccatctacttagccacccagaacagcatacattttaaaagtgaaacactcttaatgcgcaatattggcgaaaataaacaaacgtgagcttccttgggtatttactgtggtcaactggaattctgcctaaggttattattaggtatcttcctgctggtctctatccaaatgcaacatccatgtcttgcaaattgatactagtcaggtgtatttagcatggaatcaatcaattagtttcttccattcttttaggtttgttctctcactacccctccaacccaatttgcctaatgctaaacccttatggaagaaataaacctaaatcaaatataataggtagcttctgtgttttattttgatgatttagcatatagaaatcaaaagagtgcatgtatatgtcctcaatcaggcagtgaggaagatttaaagtatttagcaatgcagagttttggaagataactgagagaaaactgagtctcttaccaatccttaccaacccctaccatccccttacccatgggatccacagtcagccaggtggttaacaacttccagacacagcaatgcaccaggtgctgtggagagaaataaaagaagtgaatccaaaccccttgcccctaaaggggcatttccgtttaatagaaggtagtagtttggtttgtggaagcatgccaggatgctgaaatcccttaagagagcttttttgtaagtttgactttaacatattagactttcttaaaagctattttttatccattgaggggaagtacttcccagcagggaggactctgttaacccaatccccaagttaagaaaagtccctgcatttgaagaaaaggttttacttgctcaccccaatacatattttgggacatggaaaggatcaatccatttttgagtggatcttaagcccccattgtgggtcacatactggcctagaactctagaacagctctgcccagtagaaatacagcatgagccacatgtgtaattgaaaattttcaagtggccacagttttaaaggttaaaaaaggtgaaattaattttgtatccaaaatattatgtcagcatgcaatataaaaattattaatgagatcttatattattttcttcatactaagtctgaaatccaatgtgtatattgtgcttgcaatacatctcaattcggactagctaatttcaagtgctcagtgactacatgtggctttacagggagcttagacacttgtccagccctgttaggatcagttctgaggacctacaatgataaatacttttcatgttgcacagttcacgtatacatatatgtagtcataactaaaaccaaacatcacttttccttacttcatgttttgcactcttatactttctatgctatcctatcttattctatttcagttaagagactgttgcagtaatctagatgagagttaataagtttgaaattatagaaggacagtgggaaaggagagaactagatggatatgggaaacactaaagagataaatgccccaagatttgataactaagtctgagcatggggcaggttcagtgaaagatcaaggggccaggcgcagtggcttatgcctgtgatcccagcactttgggaggtgaggcaggtggaccacttgaggtcaggagttcaagaccagcctggccaacctggtgaaaacccatctctactaaaaatacaaaaattagccgggtatggtagtgtgctcctgtaatcccagctacttgggaggctgaggcaggagaatcgcttgaacccgggagacggaggttgcagtgagccgagatcatccctctgcactccagcctgagtgacagagcgagactccatctcaaaaaaacaaaaagatcaaggaaggcacagtttgttttctggctccaactagtgagtgccatcactgagatgggtgtgccagggaagtagagtttgtgagagttatgtctgaggtgccatggggacttccacttggaggtgtctagttcatgtttggttggggaactcaggagagagttctgagctggagatatagatctgggagatagcatggaggagatggaagtgaaattgaggcagtgaaatggatgagagtgaaattgagatagtttctggactgagaaggaagtggatggagatggttacctaggaagagtgcctcaggataatcccactacagggctaattctagaaagtaactgaccctgagccatcctatcaggttcttagagggggaaaatagaggagctgtaattaaagctattagactcctccttctattcatctgtctctacatgaaatctggttaagctaatctactttatcccagaatcttcccaggttggaaccctaagaaagactacttaaagggccaatagaagaaggatcatgaaaagaagacagagaagtatttctcaaataactgggagatcaagggaccaagggcagggtaagtttcatggagggaatgtccaatagaatcaaatgcagtagagagatcaaatgagttaaggaggaaaagtttcctttggatttagaaagaagaggtcagtggtgatgtttcagtgaagtggtgggagcggaggctggatggcagtagattgaggagcctataggtggtagggaagtggaagcttgactgagagaggaagcagatagaatgtacagtacccagaggtggacaaatcagggcttagggttactagagactagcttttccccttccttctttcgttcctttcatcttccctcccttcatctttttttccttttatttctcattcctttcatccatccaagatgtcagatcttttggttggctcattcttttaagatgatagcaacttgtgcctaaatataaatgggaaagagccagtgggagagggaaggggcgatggtgatggggacaactgatgaagggaatgtctcttaggctggacaggttgggctccagtgcacaagtggaaggattggcttcagggagaaaaaaagacacctctcccactgtagtggcaaggaagctggcaaggatggtttgggcaagaacaagttataagaggaagggtactgaaagttgaaggcctctctatctgatagcctgtttttcatctgtgaaggtggaagcaaaatcatggtggcttatttctggctagtacggaactataattctggtatatcctgggtagttgagtccagccccaggatatgtcctctcctgaggcctccaggctgtgggtagggagaagtggaaaggctgagatggttcctgatgagatgcagtgatgagagcaaatggatctgcttcgttgtggcctctgggactccacaccaatgcccatcaagccaagtctagatctggccagggagagctgaactagcccacggtgaaaggacagggggctgtcaagacaaatgtgctaaagcttggtctggacttgctggagcccatagtcttgttccagtgtcagttttgccattgaattattgtgtgcacttaagcaaatcactttcctctctggattccattctgtccccgacaatggattggatagatccttagagtgtgattctagctttcattgccttggaacttggtctactgcagtatgttctgtttgagctcatgctcctatcaaaagtctgggctaccccattcctcaccccctgttggttttatccatttggggtaaaaacaggttgcatgatcttatggtaagacacactggctaaatatgaataacaaatgttcacaagcactttgaagttttacattgatgttgtacaaaccacttctgctgtcttctgttttattcttcagatgctttctcagacaggttgaatgtattccaaatcatatatggaatgttctattcattgtttcgggaaacctgtgttgaatctcttcttaatgtgaacagtagcctcctaatttatctatttcatactacagaagtttgaaacattgggccttctttgaggcatggcagtatgggcttgaactatagaggcctttcttaatcaatgttgtccatctaagcttgctacttggggttaaagtccagcaatgggtcaggctgtagtcccaaaactcttacatctttagctggtgccccacacaaagcttctcagtgactgttagggaaataaatgcaggaaaataattatcccatcagatcactggggggaagaatgaaaaggaaaaaaaagcaaggaaggtagaaacaaactaagtcattgcaagctaggcctattttcttccaataatctcccaggtaacagcctctaccttgctaggatctgattacccgttgctggcctcagaccatagcattattgttttaacattcctaccttcctctttatcccagcatgaactgggttgtatgggaggctgggaagctgaccttgcttggggataaagagacagtttagcactcaacaatcttgaaggcagacttgaaaacacagtgattagaaaataaagcagtgagccctggtagtgtgcgcctgtgtaatagtgtgcagggccacacggggctagcctattgagcagaattcattttcatataatctcctccctcccgccaaaatctttgacttggtgtttttgttttctactcggtaattcatgcatgctgaacctgacatcaggatgctgagggttatttaaactgtcatttaagaaaaataacaacggtaataggttaatagaaacatcatgaatgatgtgtacagcctattgccaaccaaatgatgttgaaagcccattcctggtacatgcaggcttctgtgtttcatctctggtgtgcctaatattgactgtaggcacagtcacataataataaattctattgtacctccaaattgtttagttataaggtaattgttctatatgggatgcaaggctagtggtctcactcctttttctccatgggcaagtcggggaattgaacaaccattcacagtgcacactgtattgggcactgtgttgaatgctctatatgtattatctcatttaatcaggctgcagacccatgaaataagcattactattcctcatgttataagtaaggaaataaataatcaagtaatttcccaaagatccaaaaagatacatatgtatatttttgagatgaagtcttgctctgtcacccaggctgggtgcagtggcatgatctcagctcactgcaacctccgcctcccaggttcaagtgattcttctgcctcagcctccccagtagctgggattacaggtgcacgccaccacgctcagctaatttatatatatatatatatatatttttttttttttagtagagatggggtttcaccatgttggccaggatggtcttgaagtcctgacctcaagtgaccctcccgcctcggcctcccaaagtgctaggattacaggcgtgagccaccgtgcccggccccaaagatcaaatattaactgattaagctgggagttgaaattaggtttgtctgacttctaaagcccctatttccatgacacatagttcacaaacttcagtgagcagagaattgcctgctcaagctcccaggtgattcggaagcaagatgtgcctagatgcacttttagagatgctttatttagccctcccagtcatatctgctgtgtttgggaacaggagtagaaataaatcagatatctgtgttctttgtagtaaaactagaaattcaatgtaaatattttgacccagcagttgcattcctaagaaatttgtacacatggccaccaaaaaaactagtattaggatgttcttagcagtgttattcataataaccccaaactggaaactacccaaatgcccagcagaagcagaatggattaaaaaaattgtagtacactcacacaatttaatgctgggtagcagtgagattgaagaatctacaaccacctgcaggaatatggatgaatctcacaaatgtaacattgaatgaaagaagccagatacaaactaatatgcgccacatgatttcatttctataaaatataaaataaaataggcaaagctcatctttgatgttagaaatcggtgtagtggtaggagcatgggatggacgctggaagtgttaggttacgtgatatgtggctgtgtgtacttagcttgtgaaagtccattgagctgcacttaggatatgtgtacttttcttttctttgagacagagtctcactctcacccaggctggagtgcaatcgtgcaatcttggctcactgcaacctccgcctcccagttacaagcggttcttctgcctcagcctcttgagtagctgggattacaggcatgtgccaccacacccagctaatttttgtatttttagtagagaccaggtttcaccatgttggccagcctggtcttgaactcctgacctcaggtgatccacctgcctcggcctcccaaagtgctgggattagaggcatgagccactgttcctggctgatatgtgtacttctctataagtctattattctttagtgcaaagtttaaagatattattattcacaataatgaagaaagggaacactctacattgtatttcccatttccaaataattctggtgatctaataaactctaaggaaaggcatcacatcctacttacaattatagctcttggctgctaacagagcttcaaagtgctcagcccttccaggggccagtatatccagccccaaagagagtctagtgagcacttgaacgaaacaccttatgtctaggaccagtccagccctagtcaggtaatctgtgaattaaaatccgtggcccccaattgtgtactatgcctggcctcacagtcagacaggttgtgggctgaggaaatggatggcattggttaggtagcaagagtacctcagaataaccctgctacagggtgaattctagaaaatagctgacccagagcctttgcatcagggtttgggaaggggaaaaatagaagagctgtaattaaagcttttagaatcctccttttatctgcctattgctacaggaaatctggttaaattaatctactttaccccacagtcttccaggatggaaccctgagtgacaacatttagagatccaatagacaaagagtcaggaaaagaagacagagagtacttctcaaataggtgggagatcagaggtccaagggtaaagcaatcaccttactggtagttacagttttcttgtaaaatatggtttctgttaaagaaatcatccactttgcagaaaatatcatctttggaacatctttcctttagtgactcagaaaaaaagaggttttattattgaaatagaatctagcaaatacctcaagctgagacatgttagaaatatctgtacttctatccaagtatattgcaaacctcccacactgcataatttgttctaatgcttgtttctttcaatcttcaacaatgttttctatatgtcttctaaatatatttgctgacaaaggaatgcattttagtttgacatcagtttttttttctacacattagagcagctagttttactgtagcatgaagaatagatgattttgcaatggtatgagacttttgttttttctctattgagttatggaaactcaaaaaggcttctaaacatttatcgttacatgtaacagtattttgtgacatgctggattgagtatcacatgactcacaacattgaaacattaaacatggaaaaatcatagaggtttatcttcatgttctggatgcttcattttaaaatatgttaattacaataacttcataccatcattagctaatatctcaaggtgatatttaatgttattggtagcagatatttctaatggtcttctgtgagataattttcaattcagctatcttcttgtcagatcagattgggttgtcgtggttggtacctgataatgtggtggctgcagaacttttacagggagtagaagggtcagctctgccattttcttgttgttcacttgtgtttgcattatctttgctttcctatttcattgcaggaaatgtttttgttgttgttgttgttgtttgtttgtttttgagatggagtctcactctgtccccagcctggagtgcggtggcgtgatcttggctcagtacaacctctgcctcccaggtacaagcgattctcttgcctcagcctcccaagtagctgggactacaggcatgcaccatcatgcctggctaatttttgtatttttagtagagacggggtttcaccatgttggtcaggctggtcttgaactcctgacctcgtgatccgcctgcctcagcctctcaaagtgctgggattataggcgtgagccaccgcgcacggcctgcaggaaatgttttaagccacctgctgatttatgtgcattggtttagttaaaactagataatataatccacaaatacctttatctaggctcaggtgaactgcagtatattgcaataagctgaaagcaaatgaaaaaatgtcaggcgatgcaggccacccaactttcacattccctttaggatacctcatgtatttgatgtggacagaaatggggcaccagtgtaaacccatatatcagaattagaaggccaggcgtcatggctcatgcctgtaattccaacacttcgggacactgaggtggaaagatcacttgagcctaggagttccagaccatcctgggcaacatagtaagacactatctctacaaaatttttttttttaattagatgagcatggtggtatgtgcctgtagtcctaggaggctgacgcaagaggatcgcttgtacttaggagttggagggcgcagtgagtggtgatggtgccaccgcacttcaacttgggtgacagagtgagatcctgtctcaaaacaagcaaacaaaaatagatatttttcttggtttttgtaaagctttttttcttattttttgacatgaaaaataaatacagtaagtcctcacataacattatcaagaggttcttgggaactgtaactttaagcaaaatgatgtggaatgaaaccagttttaacataggctaatttatgtaaacaagagttaagttcgtatggcgtatttctggccacaacaacatcaccaaacttctttttaaaattttttattgatatatatactgagacggagtctcgctctgttgcccaggctggagtgcaatggtgtgatctcggctcactgcaacctccatctcctaggttcaagtgattctctcacctcagcctccggagtagctgggattacaggcgcatgtaacgacgcccggctaatttttgtattttttagtagagacggtgttcaccatgttggccaggctggtgtagaactcctgacctcaagtggcctgccctcctcggcctcccaaagtgctgggattacaggtgtgagccaccgtgcctggcctgattacattatatttgtatatacttaatggggtacatgtgaaattttgttacatgcatagaatgtgtaatgatcaagccagggtatttagggtgtccatcaccttgagtatttatcatttctatgtattgagaacatttcaaatcttgttttctagcttttttttttttttttttttttttgagacatagtcttgccctgttgcccaggctggagtgcagtggtatgatcttggctcagtgcaaactccgcctcccaggttcaagtgattctcttgcctcagcctcctgagtagctgggattacaggcacgtgccaccacacccagctcatttttgtatttttagtagagacccggtttcaccatgttggtcaggctggtctcgaactcctgacctcaggtgatccacccaccttggcctcccaaagtgttgggattacaggcgtgagccaccgtgcccggccacttttcaagctattttgaaatatataatacattgttgttaactataatcatcctactctgctatcaaacattagaatttattccttctatctaactgtatgtttgtacccagtaaccaacctctcttcatccctagccccgctcacccacacacacttcccagccactatctcaatgatagtggtatctatcattccactctctacctccatatgatcaacttgtttagctcccacttatgagtgagaacatgcagtatttgtctttctatacctggcttaagtggctctgaaaagagcctttgctttttgaaagtagaagttgttcacttggagctggtgtacttggtgagggccttggtgttgtgagacacagtgtgattggccatctccctaggcagcaggcacaagctgtatggatctccctggaggtgatcgtcgagtacttgtaatgcatcaggaatgatgcacttgaagatattgacaaatgagttcatgatgcccatggccttcgatgagatgccagagttgagatggacctgcttcaataccttgtaaatgtagatagagtagctttccttgtggctatgcttgtgattcttgccatccttctggctcttggtcacaccaccttcttggcacccttctttggagcaggaacagacttggctgattcaggcatgtcaccacaaatcaataactatactgagaaagaagccacttcaacaccaccacacttctaaataaagaccaaaacactgctagtatcattcaacattgaaatacatgtgagctatgtatacatttaagaaagactaataaaaacaagataattatttgccagcttattccagttcagggtaatgggtgactgggacctatcctggcacctcagggcacctggtgggaaccagacctgaacaggacaccatcccatcgcagggcacactcacacacacaacacattcataacactgggacaattttttttttttttgagacagtcttgctctgtcacccaggctggagtgcagtggtgcaatcccggctcactgcaacctccccctcccgagtagctgggattacaggcatgcgccaccgtgcccagctaatttttgtattttagtagagacagggtttcaccatgttggccaggctggcctcaaactcctgacctcaggtgatccgcccgccttggcctcccaaagtgctggaattacaggcgtgagccactgcgcccagcccacattgggacaatttaaagacactaattaacctgctgtgtacatctttgggatgtgggaggaaaccagagtacccagagaaaacccacacagatatgaggagaatgcgaaaatgcttcacggacagtagccctgacctggaaccaaaatattttttttttctcatccacgttataatgaaaggtcatcgaacaaaatgacattattcaaggatctgaggtataaacacaagtgttgctgtctaatggattgtcttgcccatcccacattagaaaacattggtttaggcattctaaatcttaccattggatccaaccatcagggagaaaaaaactgtattttcagggtgcacgttcgtttggccccttaaagaaaatgcttttctgaaccgctttttggtgctggggttctgccttacatggaaggcactatggagacaaacataaaaaaacaggactttctggctaggcgcggtggctcacgcgtgtaatcccagcactttgggaggccgaggcaggcggatcacgaggtcaggagatcaagaccatcctggccaacatggtgaaaccccgtctctactaaaagtacaaaaaattagccgggcatggtggcgggcacctgtaatcccagctactcaggaggctgaggcaggagaatggcgtgaacccaggaggcagagcttgcagtgagctgagatcgcgccactgcactccagcctgggcaacaatgcaagactccgtctcaaaaacaaacaagcaaacaaacaaaaacaggactttctgtactagggggctgttgttgagtgtatcagtaccgatgttactacagtattacccatcataccctttaaggtggcaccacgggaggaatttctctcagaactcagcatcaggaaaatgctgtgctttttcctcaatagctattttgctttgtgcttaaggacaacattaactttgttttcctctttgctgtgactactgggagcttaaagccatttttgtagtcttacctttttgaaatatagaggactgtgatatgcatttctttgggctcatttcacccctgacctttagaaaacaaacatattttgactgggcgtggtggctcacgcctgtaatcccagcactttgggaggccaaggcgggcggatcacgaggtcaggagatcgagaccatcctgggtgacacggtgaaaccccatctctagcaaaaatacaaaaaattagccgggcgtggtggtgggcacctgtggtcccagctactcgggaggctgaggcaggagaatggcgtgaactcagggggtggaggttgcagtgagctgagatcgcgccactgcactccagcctgggtgacagagcgagactctgtctcaaaacaaaacaaacaaacaaacaaaaaacatcaaaaaacatatttctcctcctcaccccagatcttgcaactattattttaaactttcaaattttatttttaaaatcacctcaagttctttggggaaggaggtggaatatgaatatgatataacattgttattgatgttcactataaacttaaattcaattatctaagaaaaaattatttagaatgtggaatttttatatcttggtaaagattgttttctattgttaatagcatctatgcatttaatgagtctaagaggctattcatggtaagttgcacttccatttcaatggtgttacaatgtgaaaaaatggccaacactgattttaagataatatctattgtaagatccctcctactctcagagatgctaaaatgtggggagaaatgtacattttagaatcaatgaaatgtgactttacttatagtactatgagtcttctagctatttgatattcactcactgctgtgaggttggaaagtggccgcatgagatggagtttggtttataagtggtcagtgttttaaggaagcctgtatctccagggcataataaaaattctgatctctgatcaccaaaagggcagtatgtactaagctgacctagatgtgagcattcaggcactggtttactggtttaaaaaatgaacttattatgtgggaactctaaataaagttggaaaatacgtgttgtttttttttttttttttttttttttttttttgagacagggtctcactctttcacccaggctggagtgcagtggcatgcaatcacagcttactgcaggcttgacctccggggaccaagcaatcctcccacctcagcctccagagtagctgggactacaggcgtacaccaccatgcctagctaatttttcatagagagagggtttcgccatgttgcccaggctgctctcgaactcctgaactcaggcgatctgcctgcctctgcctcccaacgagctgggattacaagcgtgagctactgagcccagcctggaaaatgtgtttttaaaagatatttaagataatttttaaactgtgctcttgttttagttttaaccaacttcaagatacttattctcaacaatagaaaaataggcaaaggacagattattctctgaagaaaatacaaatggccaataaacatttgaaaaatgttcaatctttttgtaatcaaaataatgcaaattgaaacagcatgctaccattttttggtctataaaattgacaaaggtaatactcaatgccagtgagatggcagcaagataggtgctttcatacgttgtaatgtgagtataaatgatacagcttttgtaggaggcaatttaccaatacatgttgaaatgttcttcaaatatttatctttaaaatgttcatacccctgatctaagtaattcagtttctaggcatctgttataaggaaataatcagaggttcagaattatgtttagcatgttatttatattagtaaagtataaataatttaatattcaatgatggagaagtatttaaattacggttctttttcagtgaaatgttttacagctatcaaaattagtgaggttgaaaactatttaagtgacatgataagataatcatgatatattgagtgaaaaaaactgtctatccggcaagattccaaacttgttaatatgtatatatgtcataccagaaagcctaaaatgaaatatagaaggagttaactatagttgtctctgggaagtagaaagaattattggtgacttttattttcctctcttaactttcccaaattttctataatatatattatgatgatgataagaaaaagctatgaaagattgacaaatatatttattttattattgagtttaaagtctgtatttgtctttatcaattatcattctcactcctgtgactttaaattcccccattcagcaaatattcttaaggaccttctatatgccaggtactgccctggggaatagggatatagcaatgagtagacagaccaagtccttgctttcttagagcttccctaatagcagggagagacggagcttaaatatacaatgtttcctcatctgatgacctggacctctcttctacctgcatccatgccctgagctgaatgagtgaatctagtctaatggctttatatatcacatactctctcagtttctaaacctgcatctctagcttagtcctttctcccaaacaccagacttatacatccaactgtctacctgacatctccacttggagatctaataggtgtgtcaaaccaaatctgtgagaatggaattgttaatttccccatccttgttgtccctcccacccctagacctactcttccagtgttttacccctcctagggaatggcaatgccatccttccagttcttcaggccagtagctttggaattatcctgattcctctcattctttcacaccctacatccaatctgtttcaagttttatggatccaaaatctatccagaatctgaccacttcttaccacctccgctgcgatcaccctgacccctgcctctgtcttcttttgcctgattattacaccagacacctcagtggttttcttgtttctacctttgacctcttacagtttattctcaacacattagccagatggtcttgttaaagctaagtcagatcattatcatgccttgttcaaaacgctctgatgcccagcactttggaaggctgaagcaggtagatcacctgaggtcaggcgttcgagaccagcatggcgaaaccctgtctctacttaaaatacaaaaattaggcaggtgtggtggcacacgcctgtagtcccagctagttgggaggctgaggcaggagaatctcttgaacccaggaggcggaggttgtagtgagccgagatcgcgccactgcactccaccctgggcaacagagtgagactccctctcaaaaacgaaacaaaacgaaacgctctgatggctcccatctccctagagtgaaagccagtctttacagtgtcctaaaaagctcacacgactgggtgcctctcatctcctttcttctggtctcacctctggctacatcttttcttttttgctcgcttcctccaagcatactggccttctagttattcctggaagaagccaggcatgttcatgcctcatggccttggcccttactgttttctctgccaggaatgctctttctccacatggctcacttgatcctttatatatttacacatacatcaacttctctgactatcctatttacagtgatacccccaacactccctattccctttccttgccttatttttttctataacacttaatcaccctttaactaaaatactacatgttttatgttcttttttgttgcttgtttattatttttaagtgttatgagggcaaaattttttgttttgttttgttccctgttgtatcctcagaagctagaacagtgcctggcacacagcaaggactcaaaaagtgtttgtctgatgttagaaaaatgaattacgggtagataccatgaaagtaatttaaaaattttttaaagctcaaatgagttttaaatattccatatacctgcaaatcatatcatttaacagttaatttctggataatagtttttatttttcaaaatactcctcttttcttaatatagacctccctcccccatccctgctacatttgggagacctgagccttgattaaattttctgcatctctgaatttaaaggagaggagatatttctttaaatttatttttgcattatgaacattgcatgaatgcattctcattttaaaaataaaacaaaatgacagacatatatggaataaacaatgaaatctcttcatctcttctctcaaaatattatctccttcccaagaggtaaccccaattaacaattcaatgtgtatcattcaagtccagtgctgtccagtagaactttctgtgatgatagaaatgttctatatctgcattgcccagtatagtacccagtagtcacatgggttattgagcacctgaaatgtggctaatgtgaatgacaaactacttttaattttatttaattttaattaattataatttgaatttaaatagccccatgtgactaatggctaccatattagcacagttctaaactatttctttttcttttcttttttctgtttttttgagacagagtttcactcttgtcacccaggctggagtgcagtggcgtgatctcagctcactgcaacctccgcctcccaagttcaagcaattctcctgcctcagccttccaagtagctgggattacaggtgtgtgccatcagacccggctaatttttgtatttttagtagaaatagggtttcaccatgttggccaggctggtcttgaactcctgacctcaggcgatccacctgccttggcctcccaaagtgctgggattacaggcatgagccaccgcgcctgtccctaaactatttctacacaattacctctctcttttcttctttttctctctcttcccccttctctctctttttactataaatgacatcatactagatagcatgtatacatacatattatacatattgctttgtgacttgctttttgcattcaacaaaatgtcttagatataattccctgtcagtacatacgtatctgtcttgctgttttcaatggtgcctgttacttataacatgtacattccatacataactaaatgaaaaaaatggatatttcttggtgctgaaccacatactgggcctcttttttcttctctccagtgacatttattggtgatgactttgcaccagctgcctgatttaagagtctacataatcagtgacacagtctaagaatccagtgattcgtgtgtgttgggcccatggttaactatattatctatttttttctgtcctctctatcttcaaaagacaaaatattctgactccacaataaataaggttttaaaaatatgttcagaaacaagtaaatataaacctaacagtatgaggctgctggattagattttgtgatgtctttttgtaattctgaatttgtggttctaaagctgatgagtttcacagcaaaaggcctacctggaagaagtagattctttctgaagtcctgttcttatctttttttgcatatcctgattaaaatgttctgtctttgtaaaattcttttctaccagagacattcttgagatggttataactttagttactctgggtaattcacttttcaattgatttctatgcttctaacatacctcatcagcattttctagctaatgtttgagcctgacaaactgttatagacacggtattaaccaaggctctgtcaagacacagatggctcactctaaaggtgaaattgaaagagagtttaataaaggtaatacttacaaaggtatgggcagggtttaaggaaacctcaaggaatagtatagtatccttggcctagaaacaatgggggattgccatcccccaggctggtaggggcaaggggtgagtgtggttaccagaacctcacacagacagctctataaagaggaccccctcacagaagctgtgaattttggtaaaaggacagaaccaacacactgcttcctagcagagaggaagccagggagacaaataccctgagctcactcttgtcctgacctccactgttttgcacgcttcccaaccaactggaagcaggaggcagagatcccattggtgcagtccattggggaagccatacagaaaagagtagaggaaaagcatagagaagggtagaaagagagtggattctggagaggcaaaagggaagatatttattacccacacattcttttagttaatcctcacaacagcttatcctcctttcataaacaaggatactaaggcttgagaggttaagaaccagcaatttgctaaaaatcaaatgtaaaaataggaaagggatattaaataatggaggtaggatttgaactcaggcctgtctgacgggattgccccactggagttaagaatagcttagcttggccgggcgcggtggctcatgcctgtaatcccagcactttgggaggccaaggcgggcggatcacgaggtcaggagatcaagaccatcctggttaacacagtgaaaccctgtctctactaaaaatacaaaaaattagccgggtgtggtggcgggctcctgtagtcccagctacttgggaggctgaggcaggagaatggcatgaacccgggaagtggagcttgcagtgagcagattgcgccactgcactccagcctgggcgacagagcgagactctgtctcaaaaaaaaaaaaaaaaaaaaaagtatagcttagcttaaacaagcaactctgcagttggcctatcaccatcagcagtactgtgctaagttctgattggttgattagcttgttgtctgattggtccagttgtcagtcagcgatgtacattgcataagtgcaggttctagcaaccatttttttgcacttaagtaatatttgcattgtccattgtccagtacctaatagcttttgttttaagtaaatatttgacaatgtccaactgaagagattctatacatgaaatgctcaacatataatgtcttctttaaaagcctgatgaaatgtggctttggtatgattctatggcatagtttatataaccagaacttatgtgacaaatgggtaacatattcaccttgtaatgactgagtattttgaaatcttcaattaggtagaaagaagttttattgcaacctagctccaagtctgtggtctggcaaggcccttgcatatgtgaggtccagggcactgggccagggcttcttaaccctttatgatccttgctgtcttctgctaaacacgttgtgcacatgtaccctagaatttaaagttatatatatatatatatatatatatatatatatatgtaaatctcatgtgccaaccaaaccccaaatttggaatatggctctctagaagggcatagtctgtcttctgtgatcttcacaagttcagaagcttagtttctatgattttcatgctcaaaagagtagtggttttccccaaatctgacgttattgaaaactgaacatgaacatgaacatgccctttcaaacgaataccttctcccattctaaaacggtcattcttcactttagaagattgctgctgcaaagccaattctgttcctgcctttcttatctctctcctccatttctctatcctccaaacccctagcatcatattaaacatgtatcatgtgctaataaacactacaaaatgtgatctggctgatttaaagtctaacctgaggcttgcaaataactacaagcaagtcatttgacctacttcattaagtctggccaaaaatatggttacatgcttttatttcttcagttaattgtttgagttaccccttctctatcaggaaatcatgtatccccttttcgaggtttttccatccctatagtctaaaaatcctgagggtttcctcagctcacagggagccaaaaaggtaactgagtttgagggatctaccactgctgttgcttcttgctgtcacttggtgtcaccttgaagactggttcagtgaagataatatctacctcacagaggtgttgtacaaattaaatgagcaaatacatttaaagtgcttagtatatcgatggatacatggcactaagtaggtactcaaagatttagctattaccttatgttatcaggccttagttttatgtagggtctacaccagaggatccctggaagcatctcagctttggcaaatggtgaagttagttcagttcctgcccctcccagaagcctctatcttactcacattgtcctgaagttgatctgcctctagtatatggaagagacagaacctaaggagcatagaattttttataaagcaaatgatttgttctggctcagagaaggagtttttttttaattgtaatctggtgtgtttggactgaaaaaacattgtctcaggtcaccgggctggttggtagtagctgggccttaaccaaagtcttcctgaatgcagagcttgatcaactcaagaagtaccctgctgtgctttagaaagcaatgttctggacagcaaggctgtggctcatttattttttcattctccccattctgagcacattgctttatacataacaagaaatagctcttctccatatcaactgctgttaaagatagtcacctgtgcacacatgcaaacacaaacacattcgcacatttaggaattctctctgccttccatctctttgtttctccttctttcctacttctaggccataataattaagaacaaaatgcacggtgcatataaaccttttcttcccctttgagtaactattgttgctttacaacgttccctatctctgttttaattaccagatttcacaccatcaagaacacaccattcttggaaaatggcaacaccttatctcctctttaataaactttgtgagtagcacatacaagatctccaaatagtaatttattttaggtcatgtgaaaaaggttcattgcccacatatattaaaaggtaatgaatcattaatgtaagctaatcccacttgccaatccatttatccatttgggttgtgtgctaaaagtccattcataagtcaatttgcagccaggtgtggtggttcatacctgtagtcccagctacttgggaggctgaggcaggagaattacttgaacccaggagacggatgtggcagtgaggtgagatcgcaccactgcactccaacctgggagaaagagtgagactccatctcaaaataaataaataaataaaaaataaataaaaatgagtcaatttgcttgtttctgtgggtaactatattatctattattatatcatattatatataatagtgaataataatagcagtaataatagctacagtttattaagtaccaggtatgttacacatattatctctgcttttcacaacagccttgcaaaatgaatagcccattttatagatgaaactgaggttcaaataagttaaggaacttgcttttaagcacacaaagtcaaaaatatttcctgcctcaagtatagctcctcctgaagtggtagtggtgggtcactcatgactttcctcaccacatctgttgggccccagggtgggcgcctgaccgaacgccagccaatcctggttaaggcctgatttgaaaagatgaacttggccaatcagattctcccttaggaatttgaattgggaaacatggaaagagtcaataagttggtaggagtctagggctgaaaggcacaatggaaagttgttaaatgagtgttgtgaagagaggctgaggaggccatgatgggccggcctattagagctgaagctgtggggcagtggaaagcaagcagcggctttaatgcagtggaaggaaatggagtcagtgggggtgggacagaaaggatcatgtgcagagagcagccaagttggtgcagagcaccttctctggggccacattctgcccctttcctgcttttccacagtttcagttccagggtagtcttaaaagaaatcctccatcctttgagctaatgttagtgagtgtctgttagtgagtgtcagttcctttcaaccagaagagccaaattaaagtacatggctagtaagtgctggagaggggatctgaacccggggtttgtggatacagagtttttgttcttgtcactgcacccctttgctacattacaaatgccactgtggtctaccacagcctatgaggtcgccataatgtatctgaaaaagaacgaatagtgaacccaagtttcctgaatccttgtcccaagtcttggtttgcttccagagccctggaggagaaggtgagggctaagaaaatctcagataactgggaggcctccagacaacattgagcttctagggtggaagggactgcaatggggagaggggatggggacaggggagggatcggttctcgtcagtgcagagaatgggggctccccaagggcagggattattggtcttatccctacttctatccccagattccaagatagtgcctgccacttatttgaatgagtgagtgaatggataaataaatggcagaagtgagtcatagcccctgtccaaatgtatggatcattcttcagtctagtgtccccaggttaaggaacacatcttaacctgtctccatctctaagaaacaattgatacagcacagtgaataatgtttaccatgactgatccactttagctttaaaaatcacaaagatgatgtagtggtgactgcaatcacggcacagttcaaagactacaaatggacaactctggattgcatttgccttgtttacaaaaacaccgcttgctttgtctggagagagtgaggttttcattttaagaggctgactaaaaaatgcagggccactttctgggcaggcttccaagtgactacatctttctcacagcgttccccagagccccagcccaagctgcctggggcagggcctctagccgctagtcgctgttgaagctaccacaggagaagtcatctgcagcctgcccaaattgctgtgcttttaagccttcccaaggcacagataacagctttggcctttgcattgaaagagacatcagagtttgtcattggccaagctggtgtgtgtgaaatataggagatggcgtgccacgcttctgagtatggcactctttccagccaagtctcctgggtgtgggtgagtctaaatgtttgaagactgccctcggttgtgaaatgttcgaagctgggcattgtgactttccaagggcatgacttggcgtatttcttaactctaatgagcctcagtttcctttttgtgaaatagggatagtattatcctatgctctagaaggatagaagtatctattcatcacggggtgctgcgaagcctaaaagagataacagcagagtatctcatctagtacctggcatactatagacactgaagagcttttgttatttctgaagcatcagtaaaaaacaaaccaaaaggtttcagtgatgatgccctatttttatgtctaacagtacagtatttctctgagactcagtggatatatttgacttcttaatcatacctgtgtagccaacaggaataaaacttcagaggaagttagtgccaaaggaaagtttgtcagactgtattccctttctttttctcccttctagaccctgactgcacctgccccatttgctgatgaaaccaactgccagtgtcaagcaccccatgaaaaactgaccattgctcaggcccgcttaggaacaccaggtgaggctgtacttctttgtcttaaatgggccctgtcttgacattttaaagtatcagaaaggggccgggcgtggtggctcatgcctgtgatcccagcactttgggaggctgaggtgggtggatcaccttgaggtcaggagtttgagaccagcctggccaacatggtgaaaccccatctctactaaaaatacaaaattagccaggtgtggtggtgcacgcctgtagtaccagctacttactttgggaggctgaggtgggaggactgcttgaacccgggaggtggagattgcagtgagccgagattgcgccactgcactccagcctgggcaacagagcaagactccatctcaaaaaaaaaaaagtatcagaaaggcccatcattatttgtgcagcacttgctttcaagcagagagttgaacttagagattataacgcagtgcaagggtaaagaagggtaaacactagcagtgataaaccagaccaaccaaaggagccaagaaaaagatgcatcagaatacagggagtttgagccccagctttgtcacttgttagttctacagccttgggcaagtcactagaaagatctgaatctgtttccttaaaacagggataacaatacctacctcacaaggtttctgtgataactagattcatcaaaagtaccaaagcatttttaaaaccatgaaggcatatacaaacctaagctactataattattgccattcttaaaagtatgcattttttaaaaaaagtttctagtgtgccttaaaaagagtgggttgtgctatagaagtttgttcattcattcatccctttagcattatgccagaggatggatagggaagagatttggaaagaattataaggtaccatctgtttttcaagagacaagacaactagatgtgaaataaaaaacattagtagcatgtgtgcaggtgcttaggggttaaaacctgcaacacagatgataactgattcttagagaatggcagattcatttggcctgagtgatcatgcaagacttccgggagggagcagaacagacattttaggagaactaagatttggactgtgtgggcagaagatgcaaaggtattgcagacaggtggaagaggaatagtgaagacagaaatagacagctgtgtaggagtgagtgttgttttagttgattgggatggggtgaaaaataagactagttgaacaggtaaactttaagccatttaacatggcataactcggccgggcgcggtggctcatgcctgtaatcccagcactttgggaggctgaggcaggcaaatcacttgaggtcaggagttccagaccagcctggccaacatggtgaaatcccgtctctactaaaaatacaaaaattagccaggcgtggtggcaggcacctgtaatcccagctactcgggaggctgaggtgagagaatcatttgaatccagaaggtggaggttgcagtgagccgagatcacaccattgcactccagcctgggtgacagagtgagtctctgtctcaaaaaaaaaaaaataataataatataaaataaaataacatggcataactctatggtttctagttgccattgcagaaaacaaacaaaaaaaaaaacaaacaaaccaaacttaagagaatccatggaatgaagaacagtttgcttaacaataataatggatacttattaagtacttactatgtattaagatctttatatgtatcatgtcatttcactatcacaactctatgtgattagtagttttagtatttcacagatgaggaaatgaaggtttagagaagttgtgaatctgcacaaggtcattcactactaagtggcagtggttcacactggagcctgcattagaatctactagagggcttcttaaaacccagatggctgggttccactcctagagtttctgattcagtccaactggggtggggcccaagaagttacatctctaacaagtttccaggtgatgctactgctccagggatcacactgggagaaccattggtaagtggtaaagttgggatttggtctcaaacctattggtcttagagcttgacctctcaaccatgacactgtgcttcctataagaatagccttcaatagagtgaagtgaggagcagagtaggcagagttaggaagctttcgtgtgagctgcttttgaaaaaggcaaaacaaggttggggaggtagcacagagcagccaaagctgttgttcccaggctttagtgtacaaagaatcacctggtatgcttgttaaacaagcagatttcctgtttcattcccttcttcccaaatctgggatggggcccaggcaagccatctgcattttaaacagatagtcagggtgattctaaagttagtggtctggagaccacacacagaaataccaacccagcaatatatccaagggatgccaaataaaagtccaggtggctgaccgggcgtggtggctcatgcctgtaatcccagcactttgggaggctgaggcgggcagatcacctgaggtcaggagttagagaccagcctggccaacatggtgaaaccttgtctctactaaaaatacaaaaaattagccaggcgtggtggcgcatgcctgtaatcccagctactcaggaggctgaggcaggagaaacgcttgaacccaggaggcagaggttgcagtgagccgagatcgcaccactgcactccagcctaggcgacagcgcaagactctgtttttttaaaaaaaaaaaaaaaaaaaaaaaagtccaggtggttatgaagaaaacagacttgacctaaagttaaagggtgagcatcaggcccaaactgaaagggcctctacctttctagggaaaggaaagggaagtagaacttactatatatctgtatatatctgctcgatgtgatgctctgtactctttgcaaagaccatgtgagatgactattattgtatcctttctaaagaggagacaaaggagacttgcagaactgaaaagtaacttgtcaagtgtcctagttgactgggtagagctggaatttgaccccaagtccattttgcctcaaacccctgctttgcctactgcaacgatctgccttatgaatcatggtccacagcaggccatggagctaagtgaaaacatgctcagacagtagctgtgatcttctgtagtggcaggactatgccatgctcactgctgtttcatcagcatctagagaaatacttgttgcatacgctgcggtcaataaatattttgtgagtgaatgaatgaaagtttggaggcaggcgggtcacctgaagtcaggagtttgagaccaccttggccaacatgatgaaaccctgtttctactaaaagtacaaaattagccaggtgtggtggtgcatgtctgtagtcccagctacttgggaggctgaggcaggagaatttcttgaacctgggaggcagaggttgcagtgagctgagatcgagccgctgcactccagcctgggcgacaagaatgaaacttcacctcaaaaaaaaaaaaagtgtgggacaagagaagtagttcttcctctggaaatagaagcagagagagtttgttctggcattttgagctggtatcaagctaactgggtgaaattgggcacctgtacattgcctgctgccaagcagtttaagcagtaataagatggtggtgtattttgaaataatacaggtcattagagggggagtgagatggaacaaagatgaactcctgatctttagaagagaaattctgcccactaacctgaggtgatgaccctgggaaattatctaagaaaatccgtgatgttgatgagtacctagccagggtacttgtgttagaaatttctttatttagaacttcaaatatcaggccgagggcggtggctcatgcctgtaatcccagcactttgggaggccgaggcgagtggatcacttgaggtcaggagttcaagaccagcctggccaacatggtgaaaccctatctctactaaaaatgcaaaaattagccaggcgtggtggcgtgttcccaggtgatgctgctgctgctactagtcctgggaccacactttgagaaccacagcataagagcaactgtcggcagtggttagaaggagtggtagggagattatccaatatcataattgttggagcattgtactgttagcagaaaagctcggagaatttttaagaatcttgctgtttgattaccatttaagaaaacaagaaaaacgttacttttttgaagggtttgttcaagagtttcaagaagggtttggtcaagaagggtttggtttcaagagtttcaagaagggtttggtttcaagggtagtaagcaatttacctgtttgtggcactgtcttgagcgtgccctcaaaaaagacaaaacatagcagaatttggtatttgataatgctcttcaagattatagttttttgtttgtttttcttttgtatttttagtggagctggtttcgccatgttggccaggctggtcttgaactcctggactcaagtgatctgcccatctcagcctccctaagtattgggattacaggcatgagccactgtgcctggcctagattatagctataactggactctcttaccatctcctacactagccatattttatgacataatataattgcctaaaatgtgttttacaaatttagaactgcccaaacaggggctgggggtacaaattctagaagaggtaatgacaaactctgcccatagctcttagctttttgaccttgtttgtgaggtcacaagggtgatgaaacttcaagagaaagaacagaataaatcaaaaaagcaatcagaatcggcacctttggtcttagctagtccagctgtggagctgtgcacatacacagtgttgtatgtattctgatgcatggagaataaatcctgtcttgacataaaggaaaagtccaggagattgtttcataggttccttttcattaaaactgcctttcttttctctctttctttctttctctctttctttcttttttttttttttttttttttttttttgacaggttgttgctctgtcacccaggctggagtgcagtgttgcaatcacagctcactgcagtcttaacctcccaggcccaagcaatcctcccaattcagcctcccaagtagcttggaccacaggcatgtgccaccatgcctggctattttttgtattttttgtagagatggggtttcactatgctgcccaggctggtctcaaactcctgggctcgagccatctatccaccttagcttcccaaagtgctgggattacaggcatgagccactgtacccggccctaaactgacttttcttaaagggaatctcggttctgattttctactttccttttcaaaaaggaagtttgtattatctgtttccacagtgtgtagaatttccctgactacatttttcaagagccgccttaatgaatctgccttattcatgtatcatctgtgatgtaatttacttaataatttttctttacatatactcactgttctaaaactttaatgtattttaaaaagcaaacatcaatcactatcatttacagaaaatagtatcattagctagtagcaatggctaatgataagcagaaggtaactacaaagtttatataaaactacataaattatataaaataaatatgtaactataagattttaaaagcttaacttgtgccactttttttgcacatcagttatacaaaaaacagtactagttgccataattactgggtgtttaataatagtttctgttttgttttaaagacaagaattcatatcagcatgtagttttctagcaggtaccaacaaggtagaagaaagagtggtgagtttgatttgcactcaaacatcatcgtaaattggttgtatgacattgggtaagatgcttaacttcactgagcctccatttgcccatccatgaaatgataagtctactttcacctggctccctcatagggttgatgcaaagattaagtgaaatacatgtgttttgtgaattgtgtgtatttctaaggtactgtttaaatgccttaaaatagccacaatccaagccttgttaatagccataatcaaagatgatcaatcactattttattgttgcttgaatctgaagcaaataccaaaaaacgcctaacataccccacagtagtgtgaatttaaacgtaacgtggttggtgattacctcctgtttggctgtatggcaggtgtgtgtttaactttttaaacaactgccaaactgctttccaaagcgattgtaccactttaaattcctatctgcagtttatgagcattccagttgctctgcattctcaccatcacttggtatggccaattaaaaaacattttttagccattctagtgtgtatgaagtgttatctcattgtggttttcgtttgtatttccctaatgactaatgttattgaggatcttctcttgtgtttatttgccatccttgtatttattttctttagtgaaatgtctgttcgatatttttgctttatttaactgggtggtgggttgttcatcttactgaggtttgagagttctttatatattctagatacaagtcctatattttgcaaatattttctcccagtctatgactcaccttttcatttttgtaaaaatgtcttttgaagagcaaacgtcatgagtctcacaggctgcatttaaggtgtcaccccaggctcagttctcatctggaggttaactgttgttagatctgcttccaagctcactcaggttgttagcagaatttatttccttgtgactgtaagatcaaggggtgagcttcttaccagttgtcggccagaggccaccctcagctcctagaggccacctgcaggtccttgccatgtggccctctccataggccctttcacaacatggcagcttgcttcttcaaagccaccagtgcagaaagacagtaagtctgctagcaagatggaccctttttgtttctttttgtggttgttgtttttgtttttttttgacaaagtttcattcttgttgcccaggctggaatgcagtggtgtgatctcggctcactgcaacctctgcctcccgggttcaagagattctcctgcctcagcctcccaagtagctgggattataagcgtccgccaccacgccaggctaattttttgtatttttagtagatacggagtttcagcatgttggccaggctggtctcaaacttctgacctcaggtaatccacccacctcggcctcccaaagtcctgggattacaagtgtgagccaccacgcctggccaagatggagtcttataatgtaacataatcatgggaataatgtctaccacctttcccatattctactgattagaagcaagttacaggtcccacacgcacttcaaggggtgggaattacacaaaggcatgggcaccaggaggcagagatcattaggagccaccttaacgtctctccacgatagccatgcaatagttgtactctgacatctttttttgttttcaattggctcctggtcattgccaaacctccagcttcacaggtcagtggtatctcacatagatgctctggaatctcacatagatgctctggagagtccccagatgcctaaaagcatatccagaaaaatctcaaacaaaagattaaaacagatcaacatacaaactaaaaagccatactctgtttttttttaaagctttattatagagtatttcaaacacacacagaagtagaacaatataatgaaccttcctgtgcctgtcactcatacctaacaaccactaacccatggccagtcttgcaccatgcacacctctgtctactctgtcctcttgaatgatttgaaacaaaatcccagacttcctagaattctgtgtatatgtctgaaaaataagagctctggttttattaaacataaccactgtatcatgatcttacctgaaaaaacaataattccttgatatcaccaaatattcagtgttccaatttctaattatcttatgtcatcatttatatatagcttgtttgaacccaataatgtccatactttacagtaggttgatatgtttttaaaatctctttcaatctgcagatccccctttcatttctctttttctttctctctctctcttttttgccttgaagtttatttgttgaagagatgaaagatcagggtccttttttggcagggaggggagtcctggagaatttcccacagtctggaaattgctgacacaccacaatttttaaaagtgagcttattgcaaaatcaactttgtaaatactcttcagatttactaaatggcctttttctcagtaattacgtcttctttctttacttttctttcctccctgcttcctgaattcatttctcttgatcacctctgaatcaataacaaaaagttttacaaaactgccatctgctttcccctggggtttatatcttaaaacaaattttcctcaattgaattcacattgaataagaacattgaaagcaaggctccctcattagacagtttgttatttcaaagcattttctatttactgtgccttatttagaatacagtataatcctatgaaggcaattctgtttgttcaaatttgtgtataattggaaataattgcaattccctatctgacataaagtctctcaactttttttattagagaaatttaatttattagaaacattgtatcatctgaatctattaatgtaacatttctttatgttccaaattaatgaggttgcattgcatcaagaaataatcacaattttaaatctaagtcttaaagatcatttaacagaagttggcattgatttcttttttaaatttatttttataacatcaatgtaatacatgcatatatatatatatataatttgagacacggtctatctctgccacccaggctggagtgcagtggcgcaatcagctcattgcagcctctgcctcctgagttcaagtgattctactgcctcagcctcccgagtagctagtattgcaggcgcctaccaccatatctggctaatttttgtatttttagtagaaacagggtttcaccatgttggccaggctggtctggagctcctgacctcaagtgatccacccctgcctcagcctcccaaagtgcatggattacaggcttgagccaccacgcccgactatttttaaaagtcagtagtactcccagcttataaagaaaactagcggtccctttctccaccttcttcacccctgattcttattccctgtaggcactcaacacttgacagtcaactttccataatgttgttgacatctctcatccattgtcattgcctttcttgttttctctgcccttgggaggattatatctttttaacttaacttttaactttaacttttaactcttaactctgtaacttttaactcttagtaattgttgtggtgtttctgggagaaagtagagataatgtgtatgttcagttcaccatatttaactgatggtctttgtatttccttttaaagaacattattagctcacgcctgtaatcccagcactttgagaggctgaggtgggcagatcacaaggtcaggagtttaagaccagcctggccaccatggtgaaaccctgtctctactaaaaatacaaaaattagctggatgtggtgctgagtgcctgtaatcccagctacttgggaggctgaggcaggagaattgcttgaacccgggaggtggaggttgcagtgagccgagattgcgccactgcactccagcctgggcgacagagcaagactctgtctcaaaaagaaaaaaaaaaagaaaacaaaacaaaaaacactattgtggccacatatgtctctttccttctcactgcaagaataaaatgtctctatgttgtttgtagccgtggagatgaggtgacaagggtgcttagaatgagagcactttgatatgagaaactacttctttctcctgtcatccatttttgaatcttcttggattttcacattctagttcctttgttgagagtctagaaaggtgtcaaggttggcaaaatacatagaattttctatataaatgtaggaggcatcttccagagtatcatgatggggatataacagagctgcaacttccttcctccaaccagttaaaaagaataattttgtgacttgctttgtctaccaaattgatggaagtctatacccaatttctctctctgacttgaaggggatgggtctttggcctggctgagcaatagtgttatcctggtctcctggttcctggaggtgctgtactgaagtgtgtccctcttcctcttggaacagcactttttagagcactagatgccactgtctgtgtgacctcttcacttttgacctttctccctaggaaggactatagtgttggttgttcatcttcagccctgagcaccacttctacatgcaacattacatcctgactctcctccctttgaggcgtatgtccctaatctcttattataccaaagaggttagggagtggccttgcagtggtatgctagtaaaggtttaacagctggtcctctagcgggaaataagccctgatttgtagcatttgccaacttctgtcgtggaagcactctatcgtggctgacttcaggctaccaacgtgacctggagttgggaagaaaggttgtaaggtgagccatgtgaacagattccagtacatcgttgcctttgagaacagggacttggggtcttcattcaggactgccacacccaaggatgaagccatttgccttttccattgagctcctcagttactcctgcctacgtgttccagctgggctgactctgccggctcaggcacctagactccactctgggtcaagagaactcctcagtgctctgtttttgtctcttctgttggctaaaatagtgtgttccctggtttgatcttaagtttgttatgtttttgctctgctttgatgtcttcagaagaacccctttaaaatcaatttcgtgcactgatatgaaactgatggtatgtagagattgtgtcttatccagaaagtttcttacgactgatagaaggtaactgggattcctcattctgcagttctgttaacagtgttttctttctcccacagctgacaggcctgtcagagtatacgccgatggaatatttgacctcttccactcaggtcatgcaagagcccttatgcaagcaaaaacactgtttcccaacagctacttgttggtaggaggtaagaagtgcattttctttttgtctagaaaactcttttattgtatgctttctgaaaagagcccctttcagagttccatcagtaaaaatctcacattgttaatgcttccaattcagcccatactggctcgcttgttcactgcctgaaatttaaaatgatgtttgaaaaaccataggggaagttacatcatgggattgtataaccctgatcctcagagagagatggactgatagtaccaccaagggtaaatgcttcatgttttccattaatgcctttctattagtgtttaaggcttgatccaaattatgttcctaaaattttctagagggataagagaagcaatattattctgatttcaaatctcaaagaactaaagggagttaggatgatgaagaacaaacaaggtcatcgtctatttcttttgtgtgacctgcagcacttaagacaatgttgtgctaacactagtggcttgtaacagccccacttagttgaatttgtagcagtgtgttaaagacatggagatttatataccgaggtaatcttggttcacaacgaagggaccaatttactcgctaagtctatggaaagagaaggatcgttagatgtggactgaaattttcctcctccaggaggcctatttctttttggctaaaagggatagtacctgactaggaagacctgtatttcacttgtgcagcttcaggaaggagcatattcattcagagtaatcagtttttgtggcatataaactaggcaccatcaagtcttacacctctactgggggaaaaaagtactggtaagagactacataactgttttttaaagaattttgttaccttctgcaattaaaaaccactttgtttgtttgtttgtttgtttgagacggaatctcactctgtcgcccaactggagtgcagtggtgcaatcttgactcactgcaacctctgcctcctgggttcaagtgattctcccgcctcagcctcctgcatagctgggattacaggcatgtaccaccacgcccagctaattttttttgtatttttagtagagatggggttttgccgtgttgtccaggctggtcttgaactcctgacctcaggtgatccacccacctcagcctcccaaagtgctggcattacaggcgtgagccactgtgcccagccaaaaaccacttgttggacatttaagaggaactcttctgcaggttttgccaagggtggtgaccacaggaccattgaatggagttctttccagaaggaggaaatggtggaaggcaatggttactgggcaagtcatgcagagggaacccaaaacaggcagagaacccaacccttgcttacttccctttagcctgaaaaccattccttgagagagcactaccacctggagtctggtcctaggctactggggccctggagagacctctgcagtgtttgggctttggtcatttgggtggcctaagtttggaggtggttaggtgtgggtcacagttaacaggaacactagctgtggccctgggttatcacatccaaagtaagataaaaggaaatgtgtagttttcagtacgttcttgtaaattggaggaggcagtcagttaatatcagcagctctctaggtcattaggcaacaatggtttcactgactcactgatttcttcatctgacaactttcttttttttttttttttttttgagatggagtcttgctctgtcacccaggctggagcacaatggcatgatctcggctcactgcaacctccgcctcccaggttcaagtgattctcctgcctcagcctcccaagtagctgggattataggcgcgtgccaccatgccgggctaatttttgtatttttagtagagacggggtttcaccatgttggtcaggctggtcttcaactcctgacctcatgatccacccgcctcagcctcccaaagtgctggattacaggcacatgccaccatgcccggctacttttttgtatttttagtagagacagcatttcaccatgttggccaggtctcgaactcctggcctcaggtgatccacccacctcagcctcccaaagtgttaggattacaggcgtgagccaccgctcccggccccttcatctaacaactctttattgaactcttactatgtgccaggcatttttctgtacactggggatgcagccatgaacaaaacagactgtctatgtcctcagagaacttgcagtctgagggagaggcagtcattgcccactaaacaagtaaatatgtagtagtggtactatgaagaaatataggaaaagagaaaagagtgactgggcggaggaaggagggatgttttaggtataaaggtcagggaagacctctctgaggaggtgacatttgtgcagagacctgaatgaaataaaagcactcaaaagccagaacatccagtcttccttgtgcaggattctcaccagtcaagacaacagtgtgaggcaagcagagaagacatggtgacatgttagttttttgatttgtgtatcttaaggaggctttccataaaagcacagatgattcagtactcagggaaattaatatgggcagaagtttggagccaagaaataaagcagaagagaaggagaaaaatttcaataagaaatcctggactttttagcagctatagcaaagggggccacacagtcattctatcactctcaaactctagaagctgaattgtaccatcaggaagaactagtttttcctgcctgagttctgagataactgtttcagagggtcactgtgtaaggggcattgagtaatccaaagaacgatgtcctctatagtaggtttacacagaatttcagatattcccttaatggctattacatgggttgtggaagtcaagggcatattgaactacttggatgaccatgagactgtatcctttggtaagtgacaaggactggagtacaggaagaaaataaaacaatacagcatcaagctataaagaaatagtatgtagacttctgggaacagtgacagagtaagagtgaaagctgggcatggtggtgcatgcctgtagtgccagctacccaggagactgaggcaagaggatcacctggacccaggagttcaagggtatagtgagctatgatcgtacctctgcatagctattgcattccagcctgcacaacacagtgagacttcatctctaaaacaaacaagaaaaacaccaaccatgggcaacacaaacaataataaataatttcagtgtgttcttttctctgtagatttcttattcttatcatctcatttaaaataatcgaattgtaatactatgaaatatcttctaaccactctgctaataaaattcagtgacatcctggctgggcgcagtggctcacacctgtaatcccagcactttgggaggctgagttgggtgaatcatctgaggtcaggagttcgagaccagcctggccaatgtggtgaaaccctgtctctactaaaaatacaacaaaaaattagcctggcatggtgctgcacgcctgtagtcccagctacttgggaggctgaggcaggaggattgcttgaacctgggaggcggaggttgcagtgagccgagatcatgccactgcactccagtctggaccacagagtgagattctgtctcaaaaaaaaaaaaaattcagtgacatcctgtatttcatatgtctccattaatttaatatttgatcccaagtctgttaaatggaatctctaacctcctgtgtataggcagactgctatgggggcatggtataagagctcaaatcccaagagtggcattgctgtctgggtgtgatttcccaaatggtgaatgcctcttggtaaaattgtaaacaaaacaaagtgcaatcttcctttgatgtacatagtaattgccttcctctaaaattctgtgtctatcataactgttgcagaaatactttgtgattgtatgcaaaacaaaggcagattctagactcaaataattttatttttctaagttttttatttaatcatttttttttttggagatagggtcttgctctgtctcccaggctgaagtgcagtggagcaatcacagctcactgcagcctcaaactcccgggctcaagtgatcctcccatcttagcctcccaagtagctgggactataggcacatgccaccatgcctggctaatttttctgtttttgtttattgtagagatgggatttcactatgttgcccagactggtctcaaactcgggctcaagtgatcctctggcctaggtgtcccaaaatgctgggattacaggcatgagctagcacactcaacctcaaataattttaaatattatgcagggactttcaaaaatcttgcagggatgtgggaaaattctcatgcagagctgccacatgcattgcaagatgactagcttcattggcccctgcccactgaatgctggtagctgcctccaaccattatgacaattaaagatggcccacagatttccaaaatgcttcctagagaatgatgaaatccttgttgaggaccactgtcttagactaggagtcttgaaattttgttccccacaatctctaaaagaattttgaaaaatctgtataccttcttatacagtttaaagcagatgtctaaaatttatatatcaggccgggtgcagtggctcacgcctgtaatcccagcactttttgaggccgaggcaggcagatcacatgaggtcaggagttctaaaccagcctggccaacatggtgaaaccccatctctactaaaaatacaaaaattagctgggtatggtggcaggtgcctgtaatcccagctactcaggaggctgaggcactagagccacttgaacctgggaggtggaggtttcagggagctgagattgtaccactgcaccccagcctgagtgacagagcgagacgccatctcaaataaataaataaataaataaaataagtaaataaaatttagatatctgcttcttaatttaagtagttataaaagatgtaaattctggaatattgtgagtattagcctttttaaaaattaataaactttattttttagagaagttttaggttcacagaaaaattgactggaaagtacagcgaatccttgtatactcctttctcgcacaggcacaacttcccctactatgaatatcctgccccagcctgatgcatttgttacaatccattagcctacattgacacatcattatcacctcaagtccatagtttacattagggttcactcttaacgttataccttctatgggtttggataaaattttacattgtccaaactcatagatgtacattgtataatgacaggtatccacaatgatagtatcatacagatactatttttactgccctaaaaatcctatatgctctacctattcatctcttcctccctgtaacccctgacaaccactgttctttttagtgtagttttactttttctagaacatcatataattagaattatacagcatgtagctttttcagattggcttcttttacttcataatattcaattaatgctcctcaatgtcttttcatggcttgctagctcatttctttttggcgctgaataatgttccattgtctggatgtaccacagtttatccattcatctgccgaaggacatcttagtggcttccgcattttggcaaatatgaataaagttgctataagcatccatgtggaggtttttgtatggacatacattttcagttcatttggataaataccaaggagtgtgattgctagactgcatggtaggaatatgtctagttttgtaagaaactgccaaactgttttccaaagtggctgtaccaggagtgggtatagctcagaggtagagcattcaactgcagatcgaagtggctgtaccattttgcattcccaccagcaataaatgagagatcctattgcgtcatgtccttgccagcatttggttgtatcaatgttttggacttttgtcattctaataggtgtatagtaggttgttttaattttcaatttcctagtgacatatgatattgaacatttttcatgtgcttcctggccatctgtagatcttctttggagaggtacctgttaaggtctgtagcccattttttaaaatccagctgttttttttcttattgttgagttttagagttctttgtatattttgggtagcggtcctttatcagttgtatcattttcaaatatttttcgcccagtccatgtctttttttttttttttttcgagaaagagtttcgctctgttgcccgggctgcagtgcagtggcacgatcttggcttactgcaacctctgcctcccgggttcaagcaattcttgtgcctcagcctcccgagtagctgggattacaggcatgtgccatcacacctggctaattgttgtatttttagtacagacagggtttcaccatgttggccaggctgttcttgaactcctgacctcaggtgatccaccaacctcggcctcccaaagtgctgggactacaggcgtgagccatcgtgcccggcccccagtctatgccttgtttcctcattctcctaacattgtctcttgcagaacagaagtttttaattttaataaagtccaccttatcaattgtttctgtcacggttcatgcctttggtgttgtatctaaaaagtcaccaccatacccagaagaaacccatctgggttttcttctgtagagttttatagtttggcattttacatttacatatagtttggcatttacatttgatttttgtgaaggatgtaaggttatgtctagattaatttttttttttttttgcatgtgaatgtccatttgttccatttgttgaaaggtctatgtttgcttgcctttgctcctttgtcaaagactggctctctgtatatttgtctgggtctatttctgggctttctgtctgttccattgatgtatttgtctgttctttttgccaataccacactgtcttgattactgtagctttatagtaggttttgaagtcagatagtgtcagttttctgacactttcttctccttcaatatcaatttggtttttctggatctttttcctttccatataaacttttatttttatttttatgtattttttaagagacagggttttgctctgtcactctgaggccctacttgagctcctggaggtaaaacccacaaaagtatttgtcccctggcttcttgaactcttagacttgtccacactgaggtgccagcgatttgtcagtttaaattttcctatcccagcactggttcctggggaggtagctctgcttgtgggtttctgctctagtaagctaatattctctctatctgcctgtttctctctccaattttgggagtagtggtttgccctgtgacctcagttctctgatggatctaagaagacctgtagatttgtcagtttgttcagtttttacttgttgtcaggaccgagtggccacttttaagctccttacctaccagactggaaaccagaaatccaatattgacattttaaaacaaaattatgggccaggcgcaatggctcccgcctgtaatcccagcactttgggaggccgaggtgggtggatcacttgaggtcaagagttcgagaccagaccagcctggccaacatgatgaaaccccatctctactaaaaatacaaaaatactagccaggcgtgcacctgtagtcccagctactagggaggctgaggtgggagaatcgcttgaacccaggaagcggaggttgccatgagctgagattgcgccactggactccagcctgggtgacagagtgagactccatctccaacaaataaataaataaatacataaataaaaaacaaaattgttaccccatcactttaatgcatctattggcatctaaatactataatgctttgaaatatatcatcaacaatttacaaaacatataacaagctattttttaacttttaaatatttataagtttcattttttccctcaaacttatattttcattctgcttctctcccataatttttcctaatgtgatgtgttttaatgtttgcaaatcttttagtgatcactgtatcatacttctctgaaacaaaaatatgtatataaattagagcataactaaccaaagcaccacattatatacactttgataaataattgttaacatagacataaatttggacagcaatgtatctcttaatgagatgaatagtatgtacctggagatgtacttatggatgaatataactgactgctagaatgaggcagggtttaacatcaattttatccctattttttccttgtcatagttataagtgctgaaatatgttgttcatgcaaatgtgtagatagaatggaaggagtttgttacagtgatgccactcaattctttgaacttctgagttatttaccaaaaataacaacataatttattattattattgccatcaaaagtaattttaatggtctatcaagtgacaatttgttaagatcctccttcaaatttgttgcaagcaatggattagaaatgacctgacctgcaaaaggatttgttgccaagctattagaatcatttgctttttctctttctgggacttctaacaaaaggctatatcaagagttattaaatgactcttaattatatcccttattcttttacttgaaagcaacttattcaactagatatagccagaaaggatttgggaaatggaaatattagtaatttaattacatcattgccaatcaagtaatttttgataaaatgcttttatcatttgcttacaaccttttttaaaaaacaaaatctcagggctacagtttcagattactaactttgcagaaaacaccatccaaccaaattggcaaaaccagtcctcattgtcaaacctactaaaaacctacaaaccaagaaaatgtcttttcaattcaaatgcattaatgtattttcagttcaaatgtattaatgtatttcaagaagctttataaaaaacactcaaaaataaatgatagaatggattatgtaaaatagaatcagtcaagattaaaatgatgtagatctaatataataagttataaacaagacaagacaataaatcaatgcacttaatttgtagtaatgcaatgtaatttatacataaaattatgtgatatttatacgaagaagagtatgatttttaaaaggcatgttattccttctctaaatattggcacacgtgtgtgtgtgagtgtgtgtgtgtgtgtgtgtgtgtgtatatatatatcaaattctagtgtttgccttttgggaataatcaaataaatatgaaaaacagaaatagttatctttagtagataccatgactaaacttttcctatgtatttaaagatagaaagggggcatatattattaaaaagtaattggtctggaggcagataataattttattttttgttataaagaggtagaaaataaacattatagacaatgagatgaattaggatgacctgtaaatagaataaatattttatgatataagttgataacacaggtttttaacttcctttttaagtaatgcgtatgaagcctgtaaaaaattatgtaaatgttttacccatgtgtctattccaatgtatcttgaaaaatttgataattctagaaaatattctagtcacatttctaagaagcagcagtaccagcctatatagctttggtttattgaagtgattttcaagtaaatagctggaaaaaagtgcttactcttatctacaagagaaaagccatttttaggattcaatatgagtgttaagaatagctgaaaaaatgcttacccttgactacatgaaaaagccatttttttagaattcactatttctttccaatgctccttttgctttgagttcttgggccttatccctaaagatccatgtgttttttgacaatagttgggagaagaggcaaagttgttgggcaaaaatttgcattattctccactctaccatattgagtttctaacactaggcttcacctgtaacagaaatgtgtgtaagacagggaaagacaggaagctttcataggttcatggtgctttgaatggtcactaactgagatttccatttggtttgccctgaaggctaaatcgccctccaccccttccaatgcaacatattaaggtttgggtggtgcctttcttttgtaaagtggagtaagcatggctttggacccagagactttcttgacctagttaatattaggaaagtgtaccactggaagttgaatctggacattgattcgtttaaaactagctgttcatggataccttttgaaaagtctatgtggctgggtgcggtggctcatgcctgtaatcccagcactttgggaggccgagtgggcggatcatgaggtgaggagttcgggaccagcctgaccaacatggtgaaaccccgtctctactaaaaatacaaaaattagccaagcgtggtggcacacgcctgtaatcccagctatttgggaggctgaggcaggagaattgcttgaacccaggaggcggaggttgcagtgagccgagatcacgccactgcactccagcctgggtgacagagcgagactccatctcaaaaaaaaaaaaaagaaaagaaaaaagaaaagtctgtgtgtgtccatgagggtatatgtatcgtagtttaaggagacctttatcttagactgtctttctggagaatgacaaaccaaccaacttaatggcagacaattctatactgaggaaagttagggaggtcttcaagaataggtgtcctgtgttgttggttgaaaggctggatcttgattactgtatgtgtggtcaacatgtaaaatgcttacagtgagttaaatgggcctgccatattaactagggtcccctttccatatgcaggtaggtttgctgtaggagttcccttgggtggagcgaagacttcactcatgaaaccactttggtcagggcaagtatggggacaagtatttggtagaaatacttggtatttgtcagaaatcatttattaaaggaccagaaactgtgataactggaggtactatagtctatttctcaaccttaggcagtaaaaggcaccacaatcgtcatggttttgccctatgattataacaccagcactttttttttttttttttgagatggagtctcactctgttgcccaggctggaatacagtaccatgatcttggttcactgcaagctccacctcctgggttcaagtaatcctcccacctaagcctccccagtaactgagattacaagcatgcaccaccacacctggttaacttttctattttaagtagagacagggtttcaccatgttggccaggatggtctcgaactcctgacctcaagtgatctgcccacctcggcctcccaaagtgctgggattacaggcatgagccaccgcacctggcccaatacctgcacttctaattttttaagcatgtagccagtaataatttgaaaattcttctatgcaagcttaccttgttggcattattttagtgaattgagactctccacttgtaaagctcttttttccttcattttaatttacaagtttgtgtcatttaaaaacaggccaaggaattaaaatttatactagtgtgtttttttccctaaaaaaatttttaaagagtcaccaaatagccacctctgcttcgcaggagggcaataaaaataacaacagtaaacatactactactactatagaagacataaagattactccacaaacttgtgtttattttattatattttaattggaactaaatattctttaagagtcccttttgcctgactggtaggaaattcagtctcagtcttttttttttttttttctttgagacagggtctcactctctcgcccagactgaagtgcagtggtgtgatctcggctcactgcaaactctgcctcccaggctcaagcgattctcctgcctcagcctcctgagtagctggaattacaggcgtgcaccactaacgcccggctaatttttatgtttttagtagagacggggtttcaccatgttggcctggctggtctcgaattcctgacctcaaatgatccacccacctcggtctcccaaagtgctgggattacaggcatgagccactgcgcctggcctagtctcagactttactgggctctctttacctccccagagtcaaacaagtgtccacaatgtttatagaaacaggagcggggcctccagtcttcaacccagggctatttttgcactgccctcactgtctgagcccagataattactagaagggagcagattcattgcacctatcacagttcagtcacctgcagtctgttcccaggtagaactcccatgcctagggcctcacattctcatctctcttgaggtcctgccactggcatctgctgcttgtgggatccatagacatttggccctttccctgcaatttggagagatctcctctctcattgtcttcttctttccagaatacccctcaagttgctctggcttcaggaaaacagcagccaggaaggcaggctgtctactagcaacttgagctcacagcacctacaaaggagtctgtaccacggggccctcatacctgcttggagtagggggcagggaaaagacagaacacaaaatctgaaggaatagatccatgagtgatcgtattttcctactactattcgtaaatggctaacattattcagcattactctctgctcataaagatgatcaaatttaattctcaaaacttcaccatgttttaaagaccagataactgaggctcagagagtttgagtaacttttccggtaatagcagagctgggattagaacccgagtctgttgggctcccaagctcaattcctatgttgtattttctctcctgtgggagcacagtgagctgccagcataggttagttgcagcatgagttcccagatagctcaatgaattcatccatggaataccgctgcccagagctctccatctggttgtcagagtgcatttgccaagactcaagaacaacagtgctgctttgggcgtaattaatgtttagacaataactggtcagcatgttcagctgcttcttgaggtcactcctgggataggaaaataggaccctgtattggcataaacaggatgtttgttttctttgtgctctatcagtaggccattatctcggtcatgtagaagttataccaaattgctcaggtgcagattcagaaagggggaggatgtggcacggcctagttttgtgctgtttaaaatagaaaatggaaaatggatgaatctgaaatccatttctgctcaatatgattctcagggtggtattttaataaggtcctaaaagaacattcaaaaagtcttagattggttttgaaatcatattgcatggcccataaagaattcctgtttatggggtcaaaaactaatatagtcaataaatcaacacatagttattatggccctactacctgtccctcctgcccaccttcccccccacctctgggcataatgggtgatttaaagacaggcagagctcttgactcaagttatttataatatgcttcagggttttcaaatgttgtcttcatcagaatcatctctgaagcttgtcaaagacagagctatctgggccccactacagactcactgaatcaaaaatctcagggagtgagctgggtttctttacatgtgtttaacaagctccttgggtgattctgatactcatcagttttcaggccagacatatggttgatgttgttttggtaatataaacttttataatagaaaacatctcaggaagtatgtataggagatatagaggcatatatatatatatttatatgcatctagaagctcattagtctctcctttgcgtgtatgttgttgaaacgttcctgtaggccaggcgcggtggctcacgcctataatcccagcactttgggaggctgaggcaggtggatcacttgaagtcaggactttgagaccagcctggccaacatggcgaaaccccatctctattaaaaatacaaaaattagccaggtgtggtggcaggtgcctgtaatcccagctactcgggaggctgaggcaggagaattgcttgaacccagaaggtgaaggttgcagtgagctgagatcgcgccattgcactccagcctgggcaacagagggagactctgtgtccaaaacaaaaaaagaaaggaagaaagaaagaaaagaaaagaaaagaaaagaaaagaaaagaaaagaaaagaaaagaaaagaaaagaaaagaaaagaaaagaaagaaagaaaggaaagaaagaaagagagaaagaaagaaagggaaagaaggaaagagagagagagagaaagaaagaaacgaaagaaagaaagaaacaaagaaagaaagaaagaaaagaaaaagaaggaacctgtagataaatataaatctattattgtaaataataataaatatttcttgagtatctatatgtatcaggctttgttaattcattcaacaaatattgttaaaagcctactaggggccaggtatggtacatcagaaaatgaaacaaaagtccctgccctcggggaatttataggggaacaccaacaataaaactaaataagacagctacatgagacaagtgtcatggggagaagtaatgcagcagaggatcacaattcagaagagggtgggtctacttgggaggctgaggcaggagaatcgcttgaacccgggaggcagaggttgcagtgagccaagatcgtgccattgcactccagcctgggcaacaagagcaaaactctgtccaaaaaacacaaacaaaaaaagaagagggtagggggaaagacttgagggagaggagaaggtgagctctatgagtatttggagcacaactattccaggtttggagaatagtgcaaggcccggacctgagaagaagcattcaagaaactgcaaggccggggagctgggatacactaggagactggtcagggaggcaaggagtgggcagaggcgtaggtcttgtcagccactggaggactttggttttactctgaatgagacaggaagggttctgaatttgggaatgacacagactgacaagcttcaacaggctcattctggccaatgagaataggttgttgggagtgggcaaggctggaatcaggagatcagttaagaggctactgcagtcatccctgggagagatgatgaaggggtggggatgggagcagtggaggtgctgagaaaaacatggcttccgggtgtgctttgaaggcagagcctgcagttttcctgatggcttgggtgtggattatgtgaagggactacaaaagaaggttttccaaggatgctgagtgtgactgttggctgtgcttactctgtggccagatttgattctgggtgtgggtcatcattcagttccaagaaaatgatcatatttttgttcttaaaacacatcttgtgagattaggcagtatttgtcttcctgtgtctggcttatttcacttaacaaaataacctccagatccatccatgttgccataaatgacaggatttcattctttttcatagctaaatagtatttctttgtgtttatataccacttatatatggaatctaaagaagctgatctcatggaaacagagagtagaacagtggttaccagaggctggggaaggtagatgacgggggacagggagaagttcatcaacgagtaccaagttacagttaggaggaataagttctggtgttctattgcacattagggtgactatggttaacaatattgtatatttcaaaatagctataagacagaattttgaatgttcttaccacaaagaaatgataaaggtatgaggtgatggatatgctaaatatcctgattagattattatacaatgtatacatgcatggaaacatcaccctctaccccataaatatgttaattattatgcatcaattaaaatttttaaattaaacacatattgtacacttaacattagtgaatttgttggctgggcacagtgcctcatgcctgtaatcccaacactttgggaggctgagaccggtggatcacttgcagtcaggagttcgagaccagcctggccaacatggtgaaaacccatctctactaaaatacaaaaattggctgggtgtcatggcacgcacctgtaatcccagctgctagggaggctgaggcaggagaatcacttgaacctgggaggtggaggttgcagtgagccaagatcacgccactgaactccagcctgggtgacagaacaagattctgtctcaaaaaaaaattagtgaatttattgtaagtacataatattttaaagaaaaaaaaatttcattgcaaagagcagtcagggtagttctgactggccaccgcaaggctctcactgggatcttggtaaacagggactgtacccacaatgatatttcttcctgacacataggagatcttaggaaagctgccttggccaaccaaaagataggatagtgaatagtatttattgttcagtttgtttaaaagcactttttttctaagttctcgaaacatcttttctaaggctgatagtggaagatatccccatttgagggttcaggaacctgagatctagaaaatataagagatgtggaggccgggtgtggtggctcacgcctataatcccagcactttgggagcccgaggtgggtggatcacaaggtcaggagatcgagaccatactggttaacacagtgaaaacccatctctactaaaagtacaaaaaaattagcctgggtggtggcaggagcctgtagtcccagctactcaggaggctgaggcaggagaatggcgtgaacccgggaggcgaagcttgcagtgagctgagatggagccactgcactccagcctgggcgatagagcgagactctgtctcaaaaaaaaaaaaaaaaaaaaagagagatgtgaaaggatgaactctactagatcaaacctttgattttatgactttcttctcttgattgagtgacctgatgtgtagtgactggccctcaatccagggaacagaagtatatgtatttgtgtgtgtgtctgtctgtctgtctcacacttgggttacaaagtacaataatctagtaaaataattggaactgattgttcaaaccattcaaacctcctgtaaatcaggcctcttggttcctctccttctctccctcctgtgtctgttcatttggtcattttatttctgaatggtaattttcactgaggggtgggataggaaaataaaaagatatgaaagtcacattaggtagtgtagagaataattttaatagaagccacagtggagaatgcagatgtaattagcattaaaatgaaattctgaattgtcggtggattttagcttactttgctctccaaatcctttgttccctttaaaaactgagtacaattatgacaagcacctagcgaggctgtgcttcttttgtcctgctgaagaagccttgtctgaaccagggtggctgtgagcaggtcctgggccgagtaatggcatttaatgcatttgcctgttttagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaaggtacttctcattctcccacattctctaagtagcaagattagggagtctggttctgcagccaagactacggaaagcccaaagtctctctcaatttctaaaagaggtaacttcaggaactgtcatgtggaactgcttgatgtggcacctttcgtccgcccaagcccgaggactggtatcctctcacttctttgagtgtgggccctggatctaaaccgcccaggtccaaatcctgcctctatctcttcctagttgtgggaccttgaacaagatatctaaccacactgtactcgcttacctcaactgtaaaatgggatgatgttggtatcttccttgtggacgtgttttgaagatctaagaggtaatcttagttaagcagttagaacactggctggcccatagcaagagctccaaaaatgtcattgtcaccaccatcaccaccgtcattattgatgcttatcgattcacaggcattctttttcatgggacaaatgaacacacatcttatccagaaagtcacaggtcagcctttaaagaaagaactttatatctatgattttgtgaccctgagaatcctactgacataagatttttattagttggaaacatgagagattcttttgatctgcatcaaattatgtgctttgtatctccctaccagccccacattaggagctattctttccttttataagcagtacaaaaaaaataagattaagctgttctaagaattttcttttctatttttaaagccacgatgcagaagagaatagagaacactgataaatgtgcatgagtaatagctgaagagacaatttcccagtgagaataaaaagaaaaaggaaaaactacaatatgatttacttccagtaatcactaccacatttttactaagcatctattgtatattcaacatgtgctaggcattatgggggatacttataatgataatgatggctgtaatttattgagtatttaccatgtgcccggcactgtgctaagggccttgtcattatatgaattgaattcaatctcacagctaccctgagaagttgttattatacattggagaggaaaaggaactaagtttgagtactaagaatagaattaataataataataataataaacatttattgaggatatactccgtactaattgtttttcagcatttttacataattatgtcatttaatccagtgattctcaactggggtgagtttgccctgaggaacatttggcaatgtcttgagacatttggggttgtctcagctagaggggtgctaccggcttctagtgggtaaaagctaagcatgtgccaatgcacaggacaactcccgacaccaaagaattctccagtcccgaatgtcactagtactgagcttgagaaatcctaattgaatctttcccctaacttatgagttatatagccagcaagtagtggggcagggaatcatactactctaaactatctctaaactacctctcaagtatttaactactgctactctaaattacctctcaaggtagagtgaaaccccattataaagggcttgttatacagggctttaaaatctaggcaaggagtgtttgcttgatgttgcaggaaacaggaataaagatgagcaggcatgaggatgaccagaaaaaaacaaaaacaaaaacaaaaaaacctgtttaaggaggataccccatgtgacagcaggatggcttggagaggagggggcctacagtgaggaaggccagatacaagttggtgtcagtaatctgggtgaccaggtcctggatttggtgtagttgcaatggagagaaaatgatgggcacacacctacatatgcatgtgtgcacacaaacacacacacacacacacatcccagcagaacctagggtgagtgaaataagtagagaaaagaggcttattccaaggtttgggtctccccaagacccaaaataaataaaataaaagtgccattggaaggggtcactcgttttcaggaagatgaattaaattcaggacaggacaggacaagatgatttaaagtgacagcaagtggtaaaagagagggatgcagtgggaattaagcccacctggcctggtgccctggcagcccgctaaacatggcctggtgccccagcggcccactccagtctttaagccttgggtaaatctaacaaattttctagtttcagcaccttatgtcccaactgaagtagtaacatgtggcctgcccacctcacaaggtggttatgaggatcgaatgaggaaagagacaaattccttttcacagtataaaatgtgacctaagtgtgagtgcccattgccatcaatgggacaggaaatgaagatttgggttcctcatcataggagggatgataaaaattcaaagaattaatgagttctctcaaggagaaactttagatgcagaaggacagaagaccaagaaatcctactctctggggtaggacaagaaagagggaccagcaaaggagagaaaccaaaacatttattcttctagttcccattatctcatagaaatgaaaatagttggaaatacatttcagccaaggattcaggtctccactataaatgtaacatacaactgccttattttgaaaaggcattatgaagtcaccattccccccttcaaatctgcagacatgcacatccatcccagtggtgacatcactcttctctctcttcaacagattgactttgtggctcatgatgacattccgtattcctctgctggctctgatgatgtttacaagcacataaaggaagcaggtgaggcattcccctgtgctcacctgtcaaccacatcacaataatcaggtgcaataagagacatctgtctgccctgggacatctgcagtgtatacaaacagggagttacaactttaggtgtcccccaggcggcttctacaagccactgttagcatgtgctaaggctcagttatggcacagataccatttaggtatttatataggaatgaacctgagcaccaaagtgctcaacttcaggtctaaggcttaatttccggggtcatcagacgaaaagtgcaggaccccattacttaaatggcagccattttcctcattcataattaagtcttcacaatgagattattggatactcccaagaaatttccttccagaagcaggtagataactggctagttaataatctggactccttctgtccaaagttagtcctgccatatttctagtgtcatcttgtcacatgttagtaatattatcaggtaccatatgtggaggcaaaaaaaaatgggtaaatgttttaatggcttggcttattttctgctattttactatctaccatgcatctcatctataggcactgtaggtacacccatgcataccttcctacatacattaaaccataatctggcaggtgcagatactatagtgagttaccatatgcatagggatttcaagaagtctagtgctccctgcttatactagagccattgttgacatgtgccatcagagccatcttccccactcctggggaccaatgagactccactcagcttgctcccaccatttcccactcagcctgctgccactacagccttttcttggtactcatggaccttcagattcttgaggtaggatgggctcctaagggtcactgacccaggctcctatctccttcttggcatcattgccagctcctggcagaactgatgcttttacattccccatgatggagaactccctgccttgtgaggcagcccgttccatcttggatggttttggctgtcattgtttaatatatgaatcccctgagtgcatctataagccaggaattgtataagagaaaatgaataagacatagacctcacccttgagagagagcagagacagacataaataattacccaaaatataaccagcctgtggcagagtatatacaatacagcaggccagggcagcatgttcgaaggtgggactgtatgaagcacagcgtgtctggagaaaataaacatgttaatgtagtgtagggtgtgtggaggtgggaggcagagatggagactggcaggacaagctggttgaggcttgcttccatatgaagttacatggaaccaaatactgttctgaggcaggggagtgtcgtgatcaggtcttttgtgtgggaaggagcaactggggggccataagtggtttccataactaaacttaactaggaaaccccatttccacagctgacagaaaaaaaaaatacacttgacatgtgaaatcattcagactcttctaggtttgtacttagactgtgtagagtaaactttttgcctttttctcctgaggtgatctaagtttctggagcactctggcctggcatgggatggggatctttagttgtgaggtctcaagacctgcttagccatcagccccacttaccagacccctgtggcagcctctgagactctgtcatctccccactttggcctgagactgtcacctccccactttggcctgtcctggccacagcatctgccgcaggattcccttccctgtgctataggtgtgctgcccagcagtcatgctgatcttaaatcttggcttccttccatattcctctagagagtccccaggaaatttaaaaactgtcctccataatctactagagggcaagggaaaccaggcaatgtcagtaagccatgtcaggccctgtctgacctgcccgccatgttggcctctgtaaaactatttctttccaaaattcctggccataaacaaggtgccagtggccctgcactgagctttctaaaggggtctctttcctgcccctgcccctggtatttgaacctgagtcagagcaagggacagaccgcactcctgttctctcatttctgctgtccgcttcccaatccctctctgcactcctcccctcaactcccagaggtgcttttcttcttcctggagagcagaaaactgccccttaattaatttcatgccttcccagggttaatatacactccagggcttatagtcaaacattctgtaccctgagtctactcagcctctggttcttaatagttcaaaagacacttctgggatttataataccctttttatactcctcaaagcttggctcttcctagtggaattcttgcctttcttaactcttctttttaaatgagccttaaaaagagcctgttttagaagttgaaggctgaacacggcctcctgtactctcagcttcatctgcctccccctgaagtcatcgagttctcagtgtccatgggaacagggcctcaggacagacatgatccctagaaatgaaaacaacattggatactattttgaaaaattattgttacataaaatgtatgtattctccctgatggcatttttgttggttcacactccttgtgggccagcctgggaagctccatgccatcccctgcagggctggtggtggggactgtaccatcctcttaggaaggacttcctgagaagtcaagagcattggataatgggaggcctgacattctcaagtctcaatcttgtttgtgaggagttccaaggaaggaaacctcatacacttcggacttggaagtctgctctggaactggagaagaaactggcagatgcctcagttacatcaagatgggttacagcatggcgtgattaatatttatttatttacttactttacttacttaatttatgagacaagttctcactctttcacccaggctggagtacagtggtatgatcatagctcactgcaacctcgacctcctgggctcaggcgatcctcccacctcagcctctcaagtagctgggactacaggcacacaccaccatgcccagctaattttaaacttttttgtagagtttccctatgttgcccagactggtctcaaactcctgggctcaagtgatcctcccacctcggcctcccaaagtgctgggattatagctatgagccaccatgcctggcctgataaataccctttaaagtcattgtaagatctgaactatgagccagctgctcctttcctaaaattgccataaggatttgttatagaccagtgcttatgaaacttagatatgcctcagatcatctgtggaatcttgtgaaaattcagattcagattcagtaggtctggtggggccagagattcccatttctagtgagctctcaggttgttagatgctgtaggtccataggcctcacttacagtagcaaagatctggaccaggcattctcatccagctgagttatccccagggtttcttgaatcagtgtttcctgggggcagtagttccttggctaccttatagtgtataggaataagcatttggtggcagttttctttctgggtgagtggctgtcagtgagctaagaatatgttgctttcctgatttggggaataaaatgtcaagttccagttgtttaggtgtaggaacaagtccaacatttttctaactctagcaatccagcatccctattgttgcataagaaagtgactcctaaagttagtgacttaaaagagcctcttgatttcactcatgattttgtggggcaggattttagcagaggcttggctgggtagttcttgcttggggtctctcaaacagttgtaatcagatgttggtgggggctgtggtcatctgaaggctcgactgggctggggctcccaggtggtacacttacgtggctggccttggatgctggctatgatcatggcactcagttgcagttgccactggggcatacaggtggcctcttcatgttgcttgggcttctcacagcatggcagctgaaaggtaatatctagagagaaagcaatcttgacagaagccacaaggcttcttctgacttagtcgtggaagtcacacagagttacttttgccacgttcatttggtacaagcaagtcactgaggccagcccagattccaggggaagggaattgggccatctttaatgcaccacaatgccctttccaaattgaatagtcaggtagcattttacttgccctagtagcacaggctaagactcgatgtaacttttcctatgtgcaaggacccttccttgtgctccatcaaatctgctctgctgattccttagcaggagggagaatcacagtaatgatctatttgggacccaggtagagaaggccagaattcatcatgggagaaagatgctcagaaatggcctcagcatccatatttggctttcatactcaaatcatggcttattttgaaagtcaaaagtctctttaaatgaaaccagagatatcaagggcatgacttaagctttacaacactctgctctgcttgtcagaactatgtgtcaaaatcctctagcaaagctggatgaaaagatggagcttaaattaaatagactgtaaggtccacattactcatcaccattctaatattgcctactactgttgaaagtttccttcattaacatgtgctttgctgcttcttaaaatagctccataaccaaatgccgcaattctgaaaagcatgataaaaaaggttctctgatcatgctcattaccgaatatttttagcagagcaataattaggatttgaaggaagccgggtatctcattatgtcaacagaggacttggcttctttcagagacctacctcccaaccagccaaagcaaatctctccctaagccaaatctactttcagttactcaaacacagagacttcaccttctggcttcaaagaaagggtaagctcatggcatcaatgtcttacatgacttgctaaaatccattagtcactagagaatcgtcttattatttcagcaggaggggtgtgggtaaaatatctgcctgctgaaagatgggatggatttctcaccagaatgttccccactgttcccacaaaggtggggatgtcgtctgagggttcccccacccaccagagcctcctgcacagctgggtcaatttgggtgctatttatgttcgtgtgtttagatggttacatcttctgccttccatttggttttccgtgttagattcttccctcctagaaagtgataaaagaagtgtttggcctagtggcaaaccccaactgtcctctgaccatggaacataagaaactggatgttttgtctctaacatcagcagtgccactctgctactgatactataaatgtgcaaatgacatcaaaagaaagctccaaagagacaccctcattggggctgcaagatggaaacattcagagagaactgggtttggaagggcacttagagatcaatattcatctagtcattcattcaagaaatattcctatggtgcctgtttgtcacccagtgctgagaatgtagaagaggacgagaaaggcatgatcccttccctagtgtagcttatagtcaacaagacagttgttgaacaagttattttataaagatcttgctgtatttggagggaaggggagtggtccatgggaaggaacaacacaccagaagacctagtctgagggttgagatatttgcttgaggaagtgacactaaagctgaagcccagtggatgcccaggagttaaccaggtaaagattgtgtctgtggcagagtgaggggaggggaaccaaccctttcaggacactgaagaaacccagcatggctgggctgaggcagggtcagcctactgcacagctccacagaatacaacagcagtccccccctgcagttgtatagcaggggggccttggtttagggagtgaaagggagagggtctgagataaaattggagagaagcacagggaagagacatgcaagctactgcacagccaagttaaggatttgactctgaatccagagaagagcagaaagccagtggagggttttgagcagacctctgacttgcatttagtaagaatgctctgtagaacttgctctctgggttgaggcagacaaaaatgacattgctggagactggttttgaggttcttgctgtgatctttgaccaagatggtgttgaattggtttaggatggatgaaagtgagtgaattagggaaacatttaagaagtagattgggaacttggttggatgtgggaagtgagagagaaagaaatggcacagatgagtcccaggtcatcatgtccaatcacctttttctcagctgaggagactacagttaagtaactcgccttcagagggtttgagtgacttgcccacgtctacaaaccaagaacccagtgcccttgtccccaggctttgtccatactgtcccatgcctgatgcctctgactgagttgccgtaatgatatgggatagaaagatctcagttgccaacaacatgtcatttcagttcacaacagaagtgtaagcataaacctgattcttgcctttgttaatatttgtgacctctttatagctctatatctgttgatatacccacatttatctttgaagactttaaggaagttctattagaacttggcatcctctgtgcttgtttattttttactcagccccacatattctagatgaaagggcctttgagtggtgaaactaccatgtacagtagactgttcttaggaagataaatcatctaaccatccctacaggcatgcctttagatcagagacgacacaaatagtacactttttcttcttttcctttagtataatgtgagcagacttccttggagatgaagcagagttgctgtgatctaattcattgactcagttgttagtcttcatttactttctcactcaatttccatttattgagcaccttccatgtgctagacacaggggctgaggtgggtgctggggatgcaaagacagttaaggcactatcagtgctttcaaaatgttcattttctacatggagacaaatatttaattttttttgtttgtttgagacaaggtcaggctggagtgcagtggcgcagtcactgctcacagcagccttgatcttggactcaagtgatcctctcactttagtctccgaagtagctgggaccacaggcgtgcaccaccacacccagctaacttttgtattttttgtaaagacagggttttgccatgttgcccaggctgatctcgaactcctggactcaaatggtctgcctgcctcggccttcgaaagtactgggattataggcatgagccaccatggctggcccaatatttttgttaatgaaagataagttaggttctgaatgttgtggattctacctgatgacgtcagaaaagacttcccagaggcataaccttgaagctggactttgcaggatgaggaagagctttgcagttaatatgagcagggagggggtatccagggcagaaaggaaaggctcagcatggataaacagcaggggccaggcaagtacatggtatgtcctggaaacaggtctgggatgatgaacatgtagcatttaaggtagagaggaattccacggaactgagggtggaagagtcacttggggccagacgtaaagtcttcattggcatacccaggagctccaactttgtcctgtaaagggggaccattaaaggagatgggtcaactgaggtgatcttaatttttcctctatccgctcttttctacttgaacagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgtaagcatgccacctcaaaccctctgaagaccaccatgccacaccaccaccaccagtgctgctgtttattgagcacttactaagtgctatgcagtgttctccctctctctctctcttttttttttttttgtgtagagatggggtctcactgtgtataatattttaagtttgatttaacttgtttttttttttttgagacagggtctcactatgttgtccagactggtcttgaactcctgggctcaagcgatcctcctgcctcagcctcctgagtagctgggattacaggcatttgccaccatgcctgtgcagtgtccttaacgctttgtatttattttctcatttaacccacacaataacccatgatgtattattatccccattttacagatgacaaaaccagtatctacaggggtaacataaattaaccaaagaacacaggtagtgagcttcacattttataaaggtgcttccttgcttccctcctcttaccccaaactctctctttagagtttttagacttgattgaagggtttctgggagatctgccccttgtaaaaggcaagagttatcttctgctgaaaggaaagggaggagggaagaggcaatgaaagctaaacccagagaaacttttttattctaacgttttaaaattttcatttgattaaggccttacagatgctcattagaaaccttaatggccatttttcattgtccaaagaaattacagctgcttaaataaagcctaaagtctttggcttccttttgtagttctaccatattgttcccacaggactgctgttagtttaataatagagcaactgttaaaacaatatttcagttctggcatacatgtgcagaacatgcaggtttgttacataggtatacacgtgccatggtggtttgctgcacccatcaacccgtcatctacattaggtatttctcctaatgctatccctcccctagccccccaccccctgacaggccctggtgtgtgatgttcccctccctatgtccatgtgttctcattgttcagctcccacttatgagtgagaacacgcggtgtttggttttctgttcctgtgttagtttgctgagaatgatggtttccagcttcatccacgtccctgcaaaggacatgaactcatccttttttatgtatgcatagtattccatggtgtatatgtgccacattttctttatccagtctatcattgatgggcgtttgggttggttccaagtctttgctattgtgaatagtgctgcaacaaacatacatgtgcatgtgtctttatagtagacaaagaacattaacagtgacttagattccctcaggatgccatttttatataataataataataaaaacaatctttaaaataagcaaaacaagctgttaaaaagcaaagagggcagcccagttgctggagatgatgttagtgattctgagcaactgtatttgcctgggctgtgaggtgccgatatctttgattaaaataagaaccctccgtacatacagaattctaacccccaaaatagacgctgtattttcaaaggatgattcatcttcaaagctagatacttaaaattacatgcagctataattatccaatagctcacacaattgatcattggtaccttcaaaataggaggggctcattaattgtgaatcgttgatcatgagttgtcctcacaaggcagggagtgttgagagtctaggctctgtaacttcatataagccgggcaacaaaatgtcaggaaatgtcggaaaatgtcaggtttgagtggcactggaacaagtggctgaacataattcagtcaaagtgattatttagtatctgatagagaataaagccctggttatttcaataaattaaactgtctgttctttcaaattgaattcggtcaaccatccaaacatgtcaagccattttcaaaagttattgctcactctctttaaacggcgtttagataagccacttagctcaaggaaccgtgcaggcagttcggatgcactcactgccttcctgtgacgacaaacctggctgcagttcagagatgaaatctaatgtgttgcatgggcgtgtagacaaatcacggaacctcagaggtgacagggacctgatgccagtcagtcacccagtccaagtccctcaatttagagatgaggaacgctgagcccagaaagggagcctggccaaggtccttcaggtcagggagaggtagaggcagcagcaactccccagtctcatgactcccagcccagtgctcattcagctattctgtgctgccctgagagccatgtatagtaactatttccagtgcagaatgaactgtggaaaagaatgatataaaggcaacagctaacatttgccaagaactcatcatatgctcatctaagtgttttacttggattatctcatttaatcctcatgatgggcctacaagggtgggtaggatgactatgtccaacatagaaatgaggaaacagaggcccagagaggttgaacaactcacctaaggtcacctagtaagtaacggaagacagagtgacctcccatagcacatatatgtatatatatagctctcagtagcaacacacatagctcatgccccagcctgaggctgcaggaaggtttggaaggtcgaaatcaaggactctttacccagttttgcaatattccaggtgtttcaaaaacttccgaaacacaggccaggcacagtggctcatgcatgtaatcccagcactttggaaggccgaggcgagtggatcacttcaggtcaggagttcaagaccagcctggccaacatggtgaaaccccgtccctactaaaaatacaaaaaattagccggatgtggtggtgtgtgcctgttattccagctactcaggaggctgaggcatgagaatcgcttgaacccgggaggcagaggttgcagtgagctgagatcatgccattgcactccagcctgggcaacagagcgagactccatttcaaaaaaataaaattctgaaacacaaaatgaactttagtcccacatagtaaagaaaaatgataagccttacccctttaggagaaacatcatgatttcatgggggaagagccacatgttattttcatggttttaatactgctctcatcaggtaacacagacaaatgcctctgccacttaatactaatgaaacagccaacatacactgagcatttactaaatgctggcctttgtgccaagcactttgcatgcattgtcacagcaaccctaaggtagggatgattattatccccaatttacagatgagaagactgaggtttagaggtgatatgtgacttgcccagcatacgatggtttccaagcacataagtagacattgctgcagaaagactataagaagaacaaaatctgagtctagagaaactatcagcacaaaagctttcatcaccaccaaggaaatcaatacagttaaattagcatagtggaaaatattacagtggaaattttagtataacacataggttctaaggcccagttaatggcccacttatttcaagcaatattgttttaaccatatcccagtaaaacagcgaactcaggcagcttctgaatagtcattgtgtgcacaattcatacttttgtctaagtcccagcagaattgaatggggttatttgcccaatatctatgcacaacaaaagacaactgtgtgttttttattctcctcttatataagtgaatccaactcaaagacatttaaaagaaagaagatattaaaaccacttgtagttccctttacatatccaaatggattaatggcagatgacttttcttacaagagatgtgcctttccatcaacctagcccttgggaaatggcaacatcttgactcttcaggttaggaacaaatacaaattggaataaaatatgaactttaatgtgaatgattgatctctctcatgtcctcttggataaatctgtttttttttttcctgtaaactttcaccaggagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatgggtatgtaatgatttcactttaccccacaatgatgagtgttttcagtttatcctcctttttatggagccactcaagggtgccccttatctcagatccactgcatgccctctactttaggcatcagcctgaatgacttcaagtccatgtcacttccttactgagtttctgctttactcgtcaatatggcacccagtagcacacaaagccacgtctggtttcagtttctagttcttatccagagcttggaagccatctggtgatcacttgagtgtctcttacttcaggagttgatgctgtcgctcatctcagtctcccagttggggatgatgaaactttgggagtacagatgaagtgggctagtggcagcacggagcttgtgttacaagacatggatcatgggatcttggatcaactactggcatttatgttttggggaggagaatccaaagaaatgtactctgtcagtcagtttttcttgtgaggagccctcctcttttactggttgcaagacagagagagaagaagtaggagtttgccctgcatctgtgcccatcgtgccctgattttcccctggtttttcatgacacgcaagtgttgggataaggcacaacagtctttggggactgaggacatgatctgaatcttaaaactgagaggaaatgtagagggtctccttgcctaaaatctgaacaactttgaatgataactatggaaagggaaaagaaaattctggaaacctccactggtactttattggtatttctattgtgcatgcccttcccaagtaaataccagtattatcaggagagttgatgaggggtctgtaaaagagattcgaaaagtttactttagagacgctaaagggttgacgagggttgtatgaaagagatactaaaaacaaaatttcctcctacaacaaaaagaaaaaattccatttgatttctctgattttaagtagcctggatttcctattataatatgagaagtctctaccaaaatccactttgacttaattattttattgacgggttgtcactgctacctctgcttgtttgagctcattcattataggattatctaaaagtgaaacactcaattagtaatagaaaaagaacaatgtttgggaagttgggagagatgctttgcttaacacctggcagcctctaagtgattatagacgtgggtgttataggccaaccatgtcctatcggctgagtctgagaggggtgaaaggtttacaaggactgcatgagccttcaaagactcctagaaagagctggcaagagtggaggagccaagggctgggctccttttcattttccccaggcctgttaaaaatttcagctcagataagttaattcctggtacatttcttaatgtttttgtctatgcatggcactatgcataaagaagaacataaaaacagacaaagtacagaccctgttctctcgtctctatgacatatggtatgaaattttctatttaatctagtgtgtattttaatagttcacattttcacaactaatttccaggctctaaagaaacaactagtggtttttaatgaaaccatgtaggtgttcattcgtttacagggattcagaaacctgtctctgctgataagagttggtatagtaactcaagagggtggatgttttctccacttggagtgagtaaaggcagggaaaaaatgtaatttcccactttgggaggccgaagtggatggattacctgaggtcaggagtttgaggctagcctggccaacatggtgaaaccccgtatctactaaaaatacaaaaaaattagccaggtgtggtggcgcgtatctgtagtcccagctactcaggaggctgaggcaggagaattgcttgagcccaggaggcggaggttgcagtgagcccagatcatgccaccacactccagcctgggtgacagagagagactctgtctcaaaaatatatatatatatgtgtgtgtgtgtgtgtgtgtgtgtgtgtgtatgtgtgtgtatatgtgtgggtatatatgtgtgtgtatatgtgtgtatatctatgtgtgtgtatttctgtgtgtgaatatatgtgtgtgtatatgtatatatgtgtgtatgtgtgtgtatatgtgtgtatatatgtgtgtgtttgtatatatgtgtatatatatgtgtgtgtatgtgtgtatatgtgtgtgtgtgtatatatatatatatatataatttgatgaaaactttatagaccttagtcatttcaggctcccagtgaaggtgaaatagtagctggaattgttcttgggagtctgatgacagcaagccaaggtgatttttaagaaatgaaacccagtttagagactggaggtttttctttttaaaacttgctattagtgtcaaaactgttattaccattaatttaccatatcagccagactaagacattactttttttctgttgacgttaaaaatacaggaatagttacaaggatgttaaacgccaagataagtaatttgcttttcatgaatatgctattattataataattccttatttgtgaatttgggactggaactcatttcttaaaatagaagatctgtattaccggcaaatacagtactgttacaaacaacccaaacttggaaaggcacaaaatagaaggatttaagatacaagttctggtacaatgagataggtatgcagcatagtatgtaacttatagtgggtattccacaaatgtttctgggttaaatgaatgtatgaatgaatggatgtatgaagaagacctattcacagaaccttccagcatctgcaaaggatttgtgtgctaaagcctaaatcccccaccccatatacgtgtgtgtgtgtgtgtgtgtgtgcgcgcgcgtgtgtgtatgtagacagatagatagatgataagcagatagatagccttagccttttattgcttatggtgctaggtacaggactttattacaacttggtgtttggtggatcaaattcagtacacagacgtggtgtgctttgcccttaacaatgttttaaaatttattttagggaaggcatgagctcttgtttgccatagtcacaccttgctccgctgctcctttcccctcccctaacctgactcacacatttatgcagcccatctggccccagggaatatttgaatttgctccttgtggtatagtcttttttaaagcagggtctcactctgttgcccaggctggagtgcagtggcatgatcatgactcactgtaacctcaaatttctgggctcaagcaatcctcccacctcagcctcccagatagatgggactacaggtgtgtgccaccatgcccagctaatttttaaattttttgtagagatacagtcttactctgttgcccagactggagtgaagtggtgtgatcatgactcactgtaacctcgaactcctgggctcaagagaccctcttgccttggcccaccaaggtgctgggattacaggcatgagccactgggattacagtgcctggccatagtcttttaagtctccccaagtgacctcatatttgacattaaggatgccaatataaaattgaagcccttacatgctatctctgagtagaaagtagtgatgatgatgatgatgatgatgatgatagtaaataagaaggtgatgatgatgatattgtctaaaagttgtatggcaggttgaattcttttttcaatgtccttgcacatttattctacccattttatttacttatttatttttatttatttatttatttttgagatggagtctcactcactctgtcaccccaggtggaatgcaatggcgcgatctcggttcactgcaatctctgcctcccgggctcaagtgattctcctgcctcagcctcccgagtagctaggactacaggcatgtgctaccacgcccggctaatttttgtatttttagtagagacggggtttcaccatgttggccaggctggtctcaaactcctgacctcaagtgatccacccaccttggcctcccgccacccattttaatcacacaggaaggtacattttatagataaatatatagatatagacaaaggcctacaaaattatacgatgaaactttcccgtggtctcacaggagttggtaggcggtaggatggagcctggggctagcctctttctcctggtcatgtctgtatccttcaccataggaatgtccacatgatgcagtcattttgcttcattttcctttggtcggggtgtgtcactgtagagaaactgaggtctaccaacatccctctaaggcctttgacaatgccagttgccagaattgtgcttgagaccaggccatctagatttatgataggcactctcagccctccactgtactgctgtctctaggctttctcagcaaacagaaagtgtggtatccatgcctattagttagcttttggtggtaacaaattacctcaaaacttggtggcttaaaacgacaaacatttattatctcacagtctctgagggtcaggaaccaggaagcagcccagctggatggttctgactcggtctttcatgaagttgcagttaagacgtcagctggtggccaggcacagtagttcacgcctgtaatcccagtactttgggaggccgaagcaggtgaatcacctgaggtcaagagttcaagaccagcctggccaacgtggtgaaaccccatctttactaaaaatataaaaattagccaggcatggtggtacacggctgtaatcccagctactcgggaggctgaggcaggagaatcacttgaacccgggaggcggaggttgcaatgactcgagattgcaccactgcactccagcctggggaacaagagtgaaactccgcctcaaaaaacaaatttgtgacaaatatattcatatattcataaacataaaatgtaccattttaaccttttttttttttttttttctgagactgagccttgctcttgtctcccaggctggagtgcgatggtgtgatctcagctcactgcaacctccacctcccaggttcaaccgattctcctgtctcagcctcccgagtagctggaattacaggcgtgcgccaccaccatgcccagctaatttttatatttttagtagaggtggggttttgccatgttggccaggctggtctcgaactcctgacctcaggtgatctgcctgcctcagcctcccgaagtgctgggattacaggcatgagccactgtgcccggcccattttaaccattttaagtgcacaatttagtgggattaaatggttgcattcacattgtcctgcaaccatcaccaccatccatctccagaacttcttcatcatcccaaacagaaactgtaaccattaaacaagagctccctatccccttctgcccccagcccctggcagccagccttctacttcctgcctctataaatttgaccactctatgaacctcatatgagtggaatcatacagcatttgtccttttgtggctggcatatttcacttagcatgatgtcttcagggttcatccatgttgtagcatgtgtcagaattttctttcttttgaaggctgaatgatattccactttatgtgtacatcacatcttttttatccattgttccattgatggatgtttgggttgatgtgaacattggtgtttgagttctgctttcaattcttttgggtatatactgagaaatagaattgctggacaacatggtaattctatgtttaatttttttgaggagccgccttactgttttccatagtggccgcacagttttacatttccacgagcaatgcacagggatctaatttctccacatcctcaccaacacttgttattttctgtttctttgtttttttttttaaataatcgtcctaattttaggcactgctaatttttaagatttttgattttgagaaaagagctacaaaatatagtttgtggatctgcattagatttcccacctgagactttgacagtttaaaaaattttatctttttttaaaaaaagattgttgttgttgttgtttttaagacagagtcttgctctgtcacccaggctggagtgcaatggtgcaatctcggctcactgcaactttgcctcctgggttcaagtgattcttctgcttcagcctcctgagtagctgggactacaggcatatgccaccatgcccgactaatttttgtatttttagtagagatgggattttaccatgttggccaggctggtctcaaactcctgacctgacctcaagtgatccacccacctcggcctcccatagtgctggggttataggcatgagccactgcgcccggccccaaatttttatccttaaacaaaggtacaagtaaaatgtgaataaacatgaaaagtttcttattatgcaactggctaattacaagagaggtggtcatgagcagggggtcactctctgggtaggtgacttaaggcaagttcatttgcctctctgggacttagtcatagcatcagtaaatggggaaagtaagcatagctgccacatagggctgttgcgaggattacattggttcatacttcatttttaaaatctatattttttgagacagggtcttcctttgttgcccaggctagagtgtagtggcacaatcatgggtcactgcaaccttgaactcccaggctcaagcgatcttcccacctaggccctctccccactcaacctgagtacctgggactacaggtgcataccaccatgcccagctaagtttttcaaaattgtttgtagagatgggggtctcacactatgttgcccaggctgatctcgaactcctggactcaagcggtcctcccacttcagcctcccaaagtgttgggattataggcatgagccatcgcacccagactggctcacacttcaacgcccttagagcagtgcctggcacctgtgtcgggcaccgtgtaagggttagttgttattgatttggccagaactgaagcatgggcccttttctctccttgagtttcatcttgcttacccaagggccaaaccaaaccagatcgtaccaggaactttatcatttcttttcggcagataaaccagaatagatctgaaatactgaaacctttaaaggcatttgtcaagacatttattgccccactagatgttaagtacttctggtttttgtttgtttgtttttgtttttttgagatggagtctcgctctgttgcccaggctggagtgcaatggcatgatctcgcctcactgcaacctccgcctcctgggttcaagtgattctcctgcctcagcctcctgagtagctaggattacagacacccgccaccatgcccaggtaatttttgtatttttagtagagacagggtttcaccatgttagccaggttgctctcgaactcttgaactcatgatccgcccgcctcagcctcctaaagtgctggaataacaggcatgagccaccgcacccggccgatgttaagtacttcttaaaagggaaaacttcataggagagaaatagaaaactactttcgtatggacaggactataaatgggattattttcttgagggaaaacattataaatggaaacctcttaatacagtgagagactgaatttaaatacctttactcttggaaaatgccatgcatactcttccttatttgttatatttctaaagtgcttttcttcccaggaagctcattacaaactgtctcctgactgtattgaattccgctcctttgcaagggaaccacccttcaaaatgcaccagaaacagatcagagagctggcaaattgaggctgggagttattttgcatggatattgcattttatgaagtgcgacaccgttgtttatcattaaagattcaagttctttcatcccctcaggcagaatgttctcagctatgagcttgattcaaactatagtagacaagtcgtagatttcttagaaagtgaacttctaatggaaatcctgacaatccattaacagcaggagggctaatggctgccacagaaaatatacttaaagattacagtaataaaaacacatattttaaagtgcctgctagaagttcaagaatgtttttaaatgttgctgttaataatagaccaccaaatccttatagcatttgaatttgcctcataaatgggtttaatctaagggagtgctgttgtactgcaccttttttttctgtttgactttgaggggggcttgatatcttttggcagaattatcaatgccttaatggaaggtaaataattggtatattagcagacgtgtggaattttaaatctggaaaagacctgagcaatcagccatcatctgttattatatctgctagaggaaacttgggactctacaaagtaacgggctagagcttagaaaggaaaaatgagtgttgggggcaggcagtgctattggtgatgcgcctgtggccttaatagttccttaccaatgtcattattgtaacacctgcccttccgcctgatctccttgcatgggttacatgagttctttcttcctactgtgatgcttttttatgataaaagtaatatatattcattatataaccattagaaagtaaagaagggactgaaaatcactcgcagtctcatcatccagagcagtctctctgttagcatttcgggttatcactcccatctgtttcccatctccgtatatgtacattccttctacaaacttgagatcatgcagaacatagtgttctaaaatcattttggctttgcagttgctcatgagtgttttctcacatgatgaaatattatttaagaacctgattctcctcatctgcttattatatcatcttggagttgtacaggtttttctaacctagttagagaatttgcagtgttgtgtgttatacattgcattgaatgtccatcatacacaataaagatttacttacatctctgattatctcctcagaaaatagaagtttttgcatctattgccaaattccccatcagaaaggcattgctgttttatcctcttaccagcagtaacatgaaggtagcccttttcctgagccctcactagctgtaacaaatttttaaaactttagcaatctgatatataaaatgtatcttatttcagccatttgcatttgttcgactactagtgatgctgaacagtttttctagctcatttacaaatttctcttgtgacttgtctatacaggccatatgttcatttttctactaagcttttcaccttcttctttttgatttataagctctgtctatataccgagatctatcatttgtaggtaaactttgcaaaaaattccactattttttgccttttttcttatttcatggtgttttttttttttttgaggtacagaagttttaaaattttgtgtagtcaaatgtcaatgttttcctttatggtttctttctttgcttttatgctgacacccaaaggtatttctaaaacacagatctgatcagactccgcccttgattaaaatctttctgggtttcttgagtaggaaatccagtctccttgtggtgctctaggtccagaccattgccaccccatgggcatttggggttctggccacactaagcaacttagacttagtactccttacttagcatgctctgtttagaaaggccatcctctactagcccccatggacccactccccatctccacccacctcttcctgggcattatcaaagacccagctgagacatgaccacctcttctaccctcttcttcccccccttcctcctgtgtagcacctggtccccagaagatctctgtaacggtttgtaaaatgaataacccaaaggacaagcaaagcctaagatggtaaataggagaattggctttcagggccagttttgtatcaaaggattgaactgagtggctgggggctaaggctcaaatgtgagcaattgaaagaccccaggcagcacaggcaggatgctcaggagttggtgggatgcagcgtctgggaggctgagcagcaggcagcaggcacagtaggctgggagcactgggggcccagtggggagcttcagggaagggctcaattctgaaagcacccagcaaccatcacatgaggtcccaaactggtaaactgatcttaaccaccgaaacctcctcccaccccacagtcttccccaaactgggaaatggcatcactgctttccaatttcttggacccgagactgcagtcacttgattcccgttcctcccacaccccatgtcccatctgtcagtgagtcccgttggctctaccatgaaaacatagccagaccacatactgtaggattctattttgatgacattctagaaaaggcacaactgtagggacagaaaacacatctgttgccagtggctgggggaggggagactccaaagggtcatgagggaatttgggagctgatgggaccctcctatgccttgattgcagtggtggtcactcaactgtatgcattgtcaaaactcacagaactggccgggcgcggtggctcacacctgtaatcccagcactttgggaggccaaagtgggcggatcacgaggtcaggagatcgagaccagcctggctaacacggtgaaaccccgtctctactaaaaatacaaaaaattagccaggccgggtggcgggcgcctgtagtcccagctactggggaggctgaggcaggagaatggcgtgaacccgggaggcggagcttgcagtgaaccgagatcgcgccactgcactccagcaagactctgtcaaaaaaaaacaaaaaacaaaaaaacaaaaaaacaaaacaaaacaaaaacttaacagaactgtacactaaaaagggtgagtttattatacctcagtaaaaatatgggggaaaatatactaggaatcctgccatttttcagcacactgccatcatcccgggccgggccaggctccatcaccatcttggatttttttttttttctcttgagacggagtctcactctgttgcccaggctggagtacagtggcgccatctcggctcactgcaacctccaccttctgggttcaagtggttctcctgcgtcagcctccccagaagcttggattacaggtgcccaccaccctgcccagctaattttttgtattttagtagagaaagggtttcaccatgttggccaggatggtctcgatctcctgacctcaaatgatctgcccgacttggccttcaaaagtgctgggattgcaggcataagccaccgcgcctggccttggattcttattgcaacgggctcataagtgggctccctgttcctgcccccgcctcactgccatctgttcccaacacagcagtcagaatggtcttttgaaaacaagcagcagattgttaatcctttgctcagaattctccagaggtttctcttctcagaggagactgtacgtgaaactgccgcctgatatgtctctggcctgatctcccgcagtgcctccccctctcccttccccaccagctcgctccatactgccacgatggcctcctcctctcctgggacctgttgcatgggtcccctcagactgaaaggcagagttctcacaatggctgccaaggccctccatggcacagccctctgtgccttctctggcaacctcttcccaaccgcctccctcagctcctccccatctatcagccctcaaggcagccgcggtgccctgcctgcgcttcctgggtgtgcgttccatgctcctttcttggggtgctctgtctggagtgcgctgccctctgatttccattcacctggtccctccccttatctcttccaggttcttcactcaagaagcgttttctcagtggggccttccccgagcaccctgtttgcaatcgcagctgccctgctcccagccccacttgctatcctctcgccctctttttctcacagaccacagatccatctgacataccatattttgtttattgtgtgattcctcctcatatctgtgagggtatgaggtcaggggttttgttttctgccacccctccagtccgtaggtcatgactacttgcctggctagtcagagacactcagttaaattttgtagatggaagaaaaaaaaggaagaaggaaagagtgttaagaaccagtggtagctgggcatggtggctcacgcctgtaatcccagcactttaggaggctgaggtgggtggatcacctgaggtcaggagttcaagaccagcctgaccaacatggtgaaaccccgtttctactaaaaatacaaaattagccgggcatggtggcgggcacctgtaatcccagctacttgggaggctgaggcaggagaattgcttgaacctgggaggctgaggttgcagtgagccaagatcatgccactgcactccagcttgggtgacagagcgagactctgtctcaaaaaaaaaaaaaaagagaaaaaaagaaccagtggtgactgtaatcttctgtcactacccctgaatatcactcggttccttactatacatagtcttggacaacacgggatgtggtatgagtgtaggtttgtgggctcaggagttttggggtagtggctctcctgcctgccttacctttttgttttgctgctgcctcagattgcaaagttaacagatgccttctctccaatttatctttagaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaat

SEQ ID NO: 4445 - DNA, 114590 bp, human
aaagggtagaggcctctagagaagataaaaagatcaggagcaggcatggtaggccatcaggagtgcatcatggaagaggacaatcgcgctccccaattgtggcgcaaggtaatgtgaatactttcttattgatttttgccttattgaatatcaaagtcagttcaaaaagtaaagtcctatgtatctgcaagtgtaatgaatctgtgctaattaatagtcacactaaaaatggaaacattatcttctccgtcttaagttgatttaaaaaaagacaaagaaaaacaaattgtgactaatatttctttatccccttgcagagtatgtcagctccctggatagacttagatgacaagaacaaatttgcttactaaaaaaaaggtcagatcaatatgctatgggagcctgagggtattgcagaaatgttttaacaaaatgttctttatcctatgaaatgagaaattctcctagtagaaacgtcacaaaatcctgattagaatacccattccttttattctgagatggagttacgctcttgctgcccaggctggagtgcaatggcacgatctcggctcactgcaacctctgcctcccgggttcaagcgattctcctgcctcagcctcccaagtagctgggactacaggcgtgcaccaccatgcccagctaatttctgtgcttttaatagagacaaggtttcaccatgttggccaggctggtctcgaaatcctgacctcaagtgaagacaatccatttctgaattcaatgttatgcaactgtcacttaagtgagaccactgtatatggtcttttctcttgggcagagggtgcccggagaatgtatttcaaggggaaccttgttaaactgaatgagttctagatggagaaagtttaggcagtgggacaaagtgttaagaaggaccccagatgatgtgaagaagagattgagggccagaggcagcttcccaacaacgaggcagagggaatttctctgcttaacggtgaagctggtttcactccactaccctgagaatggacacaggccctggtctttcctgtaccagcatcccttcaaaaccttctcatgccccttggaatggatatgggtggctggtttaagcaccatattactcagaaagtagtctaggttcatatccagcagacacttgagctacatgactgattgatcatttcgcccagttggtcccttccccagtcacctccatgttatcttaaatttggagaaatttgtactgtatattgaagactcatgagttttactagccaattgtattgagttaatgggggaatcaggaggcattgattgattgattgattgattcattcattcattcattcattcatgcctcatttcaaaattagatttgaagtagtatcaaaataactagatgtaggccagccacagtggctcacacctgtaatctcagcactttgggagacctaggcaggcgaatcacttgaggtaaggagttctaaaccagactggccaacatggtgaaaccccctcgcgactaaaaatacaaaaaaattagccaggcatggtggtgggcacctgtaatcccagctacttgggaggctgaggcaggagaattgcttgaacccaggaggtggaggttacagtgagccaagatcatgccactgcactccagactgggtaacagagtgagactctgttgccaaaaaaaacaactagattcagttctggactggtgcagatatggaaagttgagatgattcttctatgttccagtcatgtagaattaaatctgtgcaaatatcactccgtattctgataccttttgcaaattgaaaatagacaaaggcctctaatttcatggtctcccaaatgtatcacttatcattattataatagttgacattatagggtgacatgtcccgggctaagtactttccatggcttattttatgtaattgtattcaacaaaaggactcaagctcctgaccatttgcctatgctgctaatttgtgccttgatttctctattaaattgaataggcttatttaacctccttgagcaattaaaatggattacattattaatggtaacaataataaagaatgattttattaacatttttctcatgcttttcggttctcagtgtacttttctcacacaggcaggctcaacttctgtaaattaaactttctgactaccagccctttgtgtaccatagattgatacccccacccaagctgacacacgaccatttctggttactgctggtggagttacttaacagccaatagttacaagcattgctgctaaatattgaatctgaaaggtgaaaataatcatgaacttaataatcttttatagctctcaggaaatggaaactacctttaaataagagagttgagtatttattttccacatgtttaattttggtacttggttggtacttatttggaaataagagaatgcccagacattacctcaattcctcttacttcaaatactgtgatgtagatattatttatattcccatttccttccttccttccttccttccttccttccttccttcctttctttctttctttctttctttctttctttctttctttctttctttctttctttctttctttctttttttttgagacaaggtcttactctgttgcccaggctcgagtgcagtggtggaatcatagctgactgtaacctcaaactattaggctcaagtgatcctcctgcctcagccccccaaggagctaggactgcaggcatgcaccaccacatctggctaatttttaaatattttgtagagatgggggttttgctgtgtttctcaggctggtcttgaactcctggcctcaagcgatccttccacctaaacctcccaacgcactgggattacaggtatgcgccactgagccctagcctatattcccattttcaagtgagaaaattgaagctcacagaggttaattgtccaagatagcaaggatagagctggaatttgggttcccagcatccaatttcactttttctttaaatctacactgttgaataaggtagccgctaaccacatacagctgtttaaattagaattttaattacttaaaattaattaattaaaatttaaaattcagttcctcagtcacactagccacttttttttttttttttttttttttttctgagacgaagtctcactctgtcacctaggctggagagcaatggcacgatctcggctcctgggttcaaatgattctcctgcctcagcctcccgagtagctgggattacaggcacccaccaccatgcccagctaatttttgtacttttagtagagacggggtttcgccatgttggtcaggctggtctcgaactcctgacctcacgtgatctgcccaccttggcctcccaaagtgctgggattacaggcatgagccactgacactagccacattttaagtgctcagtagttatatgtggctcgtgactattctatttggacaacgcagatatagaatattccatcattgcagaaaattctgctttaaaccataatatctcttttagatatgctgaggcatgtcctcaaaatatgttgcagttctgttacaagtaatatggattttaaattttacagtaaaatctcattcatttgaagtcccctcatttgcatagcacaaagttaactttgatctgcaaattaataatatagataagagttaagaagatggttaaatgcacttcagagaccaaagatttttaagcaccatcaaataactccagaagcactcacttagatgcaagcaattgatatgataattacacatcatttttatttattcattaaaacagggatcccctaaggtgcccttgtaggaaataatgtggttagcctagttatttctaccaacccttctgctattttgaaattctatgtgaaatcattttacactacttggtttatatccaaaggcaaggaggaaggaaccttcctccttgcctttggatattaaagtagaatggtagcataaaacactttcacactgaaattttgactggatcaagatctaattccaaagccctcacttcttccactatattctgtgattccctggaaaaggtactcctgtgggctctgcacagtgcctggtatgaaataagggttcaataaatatctgctgattgactgacagagacagttctttcaagagaccatttattgaagtggactccgattttctacagcgaatacatttatcaaaaggaaaactgactcccagtttgttctttcctctttaccagtctttgctgccaagtcttcatggtgagataagggcttcctgtctgtgagaaagagatgattcccaggcattcacttgcggggagggggagtgtgatctggccagaggctttggaaactaaatctttcagctccttcagaagtgagaacagggtggcaaacatgctgccttcccagacaccagtcatcagttagctccatcagtcctcagatctgtggggcacatgttccaggtcccatgctggttctaggtaataaataggagagaagagagaatgttgagttattagagaagaatggcacttgcatttccataatatccttagcagaggtggtttcttacagcttgctgggactggtctatgacatatagcaaacattaatgccatgtctttttagcaaaaataaaacccaattcctcaatttagcagtgagcatcaaaggatatggtttgtcccttccttgtcttctttaaggaaaatttttagccatagtgaggaaagaaaaattaatagaaacaatgtaaatgtacattaaatatttagtccttatttggaaggaattgaacaacttaaaactctccaaatttatgaagcttagatatctgaacattttttaaaagccacttaaagggaaaggagatattatatttttacctttttttttttgagatggagtctcactatgttgctcaggctggagtgcagtggtgcgatctcagctcactgcaacctccatctcccgggttcaagcgattctcctgcctcagcctcctgagtagctgggattacaggcacccaccaccatgcccagctaatttttgtacttttagtagagacgggatttcaccatgttggcaaggctggtctcaaactcctgacctcaagtgaactgcccgcctcggcctcccaaagtgtcgggattacaggtgtaagccactgcatccagccttatttttatcttttgttccaaacatcagtaggccttctttcctcttatctatctccctgcaattcctctacctgagccctaatattacaggtatgtatgtgtacagccttcaagctaacccaacacagttttgtctccttcagaaactaaggggtaggctgattcaagagtcctcttaactcacctagtggatgtataatcactgccataggctgctctgctgatagttctcactctgaacattgacaggtggagcaaaggctaattctgaatctggctctccgcttgatcttagccaaaaggccaagaagcgacgtgaatctggctctctagagtgcactaacctctccctggcagaccctagattcctacccactgtggtcctctaaggcaagttttggtgaccatgccttccctaactcctctttggctccctgaaatggcccaattaccatgcaagcagatgtggagtgagaggctagacttgtgagtgtctcttgtgaaatctggggcttccccagtcttcccagtgctgggaacaatgtgagagaaaataagtcttatgagtttatcttatttttgccctttattctcaaggacttggagccagctctcaaatactatggggtaaagaaaatggtgcaactggcataaaattaattttgccccattctcacaatgaggcctcaagaagtgaaatatattttttatatcagtcctgccccaggtattagaacattttaaagttttctttgtctttccatgaactacaaattctctctctctctctcgctctcacacacacacacacacacacacacacacactcacacacatacacggaaagagaaaagaaaatttaaaaattggtaaatatggcccaggagaaagacaaaaataatacctatttcaaatctgtttttcttagctccattgatgtaagtcataaataaaagtatagaataacttaatgataatttcttttggaagcaaagactaacatgataatttttaatagtaccattatatttaccaaaaaatcaatctttaagagtttgtcctacatatatctttacatatatcttcttgttctatatatcctttgagagtggagatgatcacatttatcttggatgcatgacttccaacatgcttagtaaatgtctgtagaatgagtgaaaggaatttaaatcactgtttattctgtatcctccttgcccagagaaactcctgagtttgtccatctaaggtcatctctaggctgttcaggagaatgagtgggtttcaacccagattttgagtgagacatggatcaatgttggatggaccaactccaacttgaccctagcgtctaaattgattgacattatcattaacaccagcaacacagatgttgtgatcactgtttacaaggctctctacctcaaccctgccagactcctagggttgttagaggtttctgatgtctgaaggccaggcgagacccacctagagataccacagatggcagactcaaccttctacaactcctcagctttctcagaggtaggcaggagctggggcagcctcgaagagagataggtaagacttgtgcacctacctgcctcataaatttttttccatgtggttactacatcttaccttagggtggcaaatgaaggactttcttaagtctcacacaaagaattcaaaacaaaaaaatggagaattaataaaaaagctttgtagggctttctccattatacaaggtaggagagagttatagtcaccaggaagtacagtagaagtcttcttaccctctacagtggggaccagttggtcagttaattgaaaaataaaatggggccaggcgcggtggctcacgactgtaatcccagcagtttgggaggccgaggcaggtggatcacctgcagtcaggagttcgagaccagcctggtcaacatggcgaaaccctgtctctactaaaaatacaaaaattagctgggcgtggtggcacgcgcctgtaatctcagctactcagggggctgaggcaagagaatcaactgaacccaggaggcagaggttgcagtgagccgagatcacaccactgcactccagcctgagtgacagagcgagactctgtctcaaaaaagaaaagaaaagaaaaataaaatgagtataatggggactcacttaaaagtgataaatgcatacattaaacattttatttaaatttaaaataaatatattattaatttgccaaacctttgattgggccactgattagagctctgtgttgtattttttcattaggcagacacatatgcattgcctattatttccatttttagtttattctaaattgagtgaaaacttaagatatcttcaaaacactttgaatatggaatcctaggtgtttttcaatgttgtcccctagcttttacagttgtcttgcccttacctaattcaacagtaatttttaattttaattttttttttgagacagtcttgctctgtcacccaggctggagtgcagtggtgctatctcagctctctgcaacctctgcctcccaggttcaagcgattgtcctgcctcaggttcccgagtagctgggaccacaggcgtgcgccaccatgcccaggtaatttttgtatgtttagcggagatggagtttcaccatcttggccaggctggtctcaaactcctgacctcaagtgatttgtctgcctcaacctcccaaagtgctgggattacaggcgtgagccactgcacctggccaaagatgggctattttaacaagagaaatataatctgtttgtggagcagtgtctgaatccccttcatctcaatcctcccccattggcataatagttggaaacaaagactacagagctgtcaggagatggtacgtcctttccacgagttaataaagtgatgccccgctttcacaatctattaattaagaaggtaatcagtgcatgctttgagtttggtaagtgaaacttgaaggcaataaaatcagaacactacttggattttttttctcataaagaaatgaataacaaattagggccacagagctagagtaatcacatttcgaatttctcctgagcatgtctttaataacctgtatgcgttaggtaagaagaacaaagaaaggcaaagttaattacccaggaaaggttcatcaagaaattttggttacattagcccagggtttctcaaccttggtatgactgatattttgggccagataattctttgttgtaggggctgtcctgtgcataggacataggatgtttaatagcatccctggtctctaaccactagataccagtagtactccccttccccaagtcatgacaaccaaaaatgtctccagacattgttaaatgtctcttgtgggacaagatcacccccattcagtagctgagaactactgaattcaccatatacattccttctcattccccatcccctggagccctccagggtttgctgtgtgttttgttttgttttgttttgttttgtttttgagacggaatctcgctctgtcacccaggctggagtgcagtggagtgatcttggctcactgcaacctccacctcccgagttcaagtgattctcctgtctcagcctcctgagtagctgggatcacaagtgcccgccaccacgcagtggctagtttttgtgtttttagtacagatgggggtgtcaccatgttggccaggctggtctcaaactcctgacctcaagtcatcccccccagcctcggcctcccaaagtgctgggattacaggcatgagccattgcgcctggccagtttgctgttttaaacacttagaataaaacgcttcagatcagggccatctatctacattttccagggaattatttggaaagaaatcgactagatcaaaattacttgtccagataacaagaagggctctttgcatttctgtattgaaaagcagcaggcaaaaagaacaaaggaagatggtctaataaaggtatttatttaaggcattcagccaaacacttgacttatatttaatccccacaaaacccccagggggcataagtagttttattttattgtggaagaaactgaggcttaaagaggtcaagtactcgctcaagaacacagagtttgtaacttactggtggagctagaaatctgacagcaaagtttgtgcatttgtgcatattgcctcagtatatgtacttaaaatgtcatacatctaaaaaagcaaggtgaccagtttttatccttcttaaagtaattttttttattagggaaagcttcaaccatacacaaaattagacaagatattaatagtacattaccatttgtactgttcatgtacttgccacctacttcaacagtaatcaactcatgacccatcttgcttcatctagagcttctcaacctcagcataatagacattttgggctagaaaattgtttgtcatgggtgtcaagcacacacaagacaaggcaaggtctgaatgacttgactggtaaaagtataactaatcacttttagattaagacagtttattacttacatagcaaaggaaacagtagcctgtggtgccagcttcgtactgtgcttgtcccacataccaaaaagaaggactctacaacaaaaggggccggataacctcgactcccattgctgaggagcccactgtagattgcaactaagtgtttttctgttctgtaactttgtactgggaggggcagggcaggaagacccatatcccaacccaaacaaagagactattagaaactgcttcatgacagttgctcaggggagataaggaggtgagtggcaaatagccctggaacaactcttcacaggcctccctgttccaggagagcttgttccaggaggatcacaaggcgttctccaacactcagatgagctgcacgtcaagcctttgcctctatggacacattcaaggtcatcagggtgccggggcagagccattatcttacagtggacgattgtcctgtgcattgtaggatgtttagcagcatttatggccttcacccactagatgtctacagcacccccagccccaagatgtgacaacaaaaactgtctccagacattgctaaatgtaccttgcagcaaaattgtacccagttgagaaccactgattctatccactccccacatccaaacaacatatttcatctgcaaatatttcagtatatatttctaaaatagttttgaaaacataaacacaatacctgtttgtttgtttgtttgtttgtttttgagacagtctcactctgttgcccaggctggagtgcggtggcgcaatcacagcttactgcagtctcaacctcttgggctcaaacaatcctcccatttcagcctaccaagtagctgggaccacaggcgcacaccaccacacccagctagttttgcttttttatttttagtggagatgaagtctcaccatgttgcccaggctgttctcaaactcctgggctcaagggattctctggtcctggcctccttaagtgctgatattacaggtgtgagtgacctcaagcagctacagtatcattattatacctaaataaattaacaataattccttcatagcatccagaaattgttcaaatttctaactgttttataaacattgtcatttttacagtgttttgaattaggattcaaataatacagtgtacatattgcaattgattgatatgtcttttagatctcatttaatccataggcttcttgcaattttttggttgaagaaacaaggtttgttctatagagttttccacaatctagattttgctgattgcatccctgtggtgttaacatactcctttatcccttctgtatttcctgtaaattggcctcagatcaagaggtgtgatcaaagccaggttctatttacttggcagactatttcataggtagtacatgtacttctattaggagtacataatgtttggtattgcctgtctttctgtcatgttagcagtagttgatgctaagtgcctaagcccaatctttccttaggggttataaagtggacataattcattaccatcttaccttcttcattactcattctaagacaagatacttctcttgtttggtgacctagagggacagtttgtataggaaaggttaaataaaggcttgatcatttcccagttttcaaaataatgtgtttttctctagcatccttcaatgcagacaaatgaggcttaggggttacttttgatagtattatgaactcatgcattgaaaaacattagatacgtttccatcaattgcagttcttatccttattgatgcttaaacttttcatctttggctgtcaggagtctccaaagtctttttgatgatttctatctttttttaaaaaggataatataacttatatattcatatgagtattgttatcttcacactttcaaatgatgaccaaagacttattccaaaaatgttttgagcaatggtagtaccatatgtgctagagactgccatggttcactgctaatggttttgctcctgttgagttcctgcaattgaatggtggaatgaggttgttatccagaccattttgtagaaataaaggattatttttctttgaagatgtgcttatatcatacttgcttactcaagagaatatcttctcaaagcaagggtgggcttctgtgaaagatcattgaccgcatatagctactctcaggcacccttagtgtcttttttttcctcttttttttttttttttttgagatagagttttgcccctgttgcccaggctggagtgcaatggtgagatcttggctcactgcaacctccacctcctgggttcaagcgattctcttgcctcagcctcccaagtagctgggattacaggcgcatgccaccgcatccaggtaatttttgtatttttagtagagacaaggtttcaccatgttggccaggctggtttcgaactcctgacctcaggtgatctgcccgcctcagcctcccaaagtgctgggattacaggcgtgagccaccatacctggcctccttagtgtcatttgacatggcctctcatctggcattttagtagactaggtgtttaaaatgattgcttttggagatattgaaagtttttacatagccagcttcctgggacacatacacaaatagggtttctcactcttgatacaaacaaaatagagatcctttttttctatttgagagccaaatagttttggggtcaaaatccatgtatgaataaagtgtctcatcatctctccttcatcacagtggttctgaactttttttttgttctaaacttttaaaagccctgatgctaaaccccaggacaattagatcagaatctttagggagcaggaatcagccctcagtgtttttgaaagctcctaaggtgattctaatgcacaaccaaggttgagaaccttccagaataaagcaaagtggataagcgtctttattaagagattaacttagacttcctgctatggtttgaacgtgtcccccaaagtttatgtgttagaaacttaatccccaatgcaacagtgtctaataataggtgattaggtcatgagggctctgacctcatgagtggattaaagtcattaacacaggagaggcttagttaccacaagggtggatttgttataaaagcaagttcaactccctcttgcttccttgctcttgccttctcttgcccttctgctttctgccatgggatgatggaacacaaaggccctcaccagatgctggcaccatgcttttggtcttcccggcttccacaactatgagccaaatacatttctgttcattataaattacccactctgtggtagtctgttatagcagcataaaacagactaagacacccctaaagtgttagacactctttgtcaagaataggatatttgtatactcgtgggcttttggaaagatcatttctcaccagcaccacctgttattcacagatttacacattgcccacagagaagaaaacctggtgaggccacttctgtttgtattgcagaggaagaacccatttgatgccacttttaggaagatttattagaggatatggagacattatcttcaatgtgtgttttgtgatgacatcctgcactggcacttactgaatgagtcaaatatgatatttatagggccttaataaaagcttttatctagctaggttgtattattaaatgtcaaacaaactaaatgaaaagctttcaacgtgaaggctatccaaaaagagcagaatgagcagagcattaaaaatgttgaggtaccaaggcatcatgcattgagtgggggctttgaggtcccacagtcctaaatgtgaaactcagttctgccactgaccagttctgtgaccttgagcaaattatttaatgtctctgagccccagttcttatctgcaaactagacataatgcctgtttctgatacagagaaggatgtcataaattactaagtcttaaaattgtagacaatgttagcaattgtctgcaattgaatgactgttagccatatttccataatatctggagatgagataccaggcccagctcatgctaaggaagatgtgataggaagaataagggcctcccaaagatgtctacattgtaatttccagaacctgtgaatatgttaccttatatggcaaaagagactttatagatgtgattaagttaaaggtcttgagatgggagagattatcctggattatccaaaggaactcaatgtaattacaagagtcttttgaagtgaaagaggaaggcaggagacttagagaatatgtgaccagtgaagcagaggctggagtgatgcaattgctgtctttgaagatagaagaaagcaggccaggagtcaaggaatgcatgcagcttctagaagctaaaaaaaaaaaaaaaaaaaaaaagcaatgaaacaatttcccctagagcctccagaagaaatgcagtcctgcaggtacattgattttagcccactgagacccatttcagacttctgaccctggtccagaactttaagataatatctttgtgttgttttaagccatcacatttctggtacattgttacagcagccgtagaaaacacacagaagcacagaagattaaacggagtctctctttgagcattcaaagactctgagtgcagattttgcaagacaaagaatcactttggagaccatgtcattcaaaatctattagtataaagtccgatgattgtaataatagtttacttgcaaatgaatgtatccctcctggcgtcagatggtcctgatgactcacttgtcaatcaagctcatttgtatcatatgcagaaggccccccggcacaatcctcaggaccctgcagtacttgctgtagtactgggaaactgcctggtaggacagcaaggaggaaatctggttatggtacaccaataatcaagaaagaccactctttaggggtatgcaaagaagtgtacatatggtcacccatgctggaggataatttgataacagtgtcaaaaaaacatgtatcaaaagctttaaaaacataaatactctgactcagcaattctactttaagaaaattcatcctagaaggagaaaaactggattaatatgcacatcattcacctgcttaaaaaaatccttttctggttcctataattgcttatagaataacacttggggagactgaagggagacagcagtacatccacttatgttagctaattaagactggcaggtgttcatactgggcgtagcttggtgtagacttgaacctggttagattattaaccttgaaggtctctgagccacctttgctacatttgctctttttcattaaaatgactgaaacagtgattgtgactaagagtttcaatgttaagtcagtgcctggccttgtacatttatcataaactatcatccaattttgtgggttaaataaattacaattttatatgtgtgtgcaaatgagcccttaagtgttgaaaattacctatggtcttactcatccactgacattcagataatatatttggcatgcaaaagttgtgaatccaaattatgctcaaatataagtgaggaatatttatccattttttttctgatgtattatctgtttcagctgcatgtctggactcaaaccccataaagaagggaccaaaatttacatggcactcttgagtatgatggcggctgtatttggagttttgattaaactgcactacatgtgtgattattacttgtaaacggatgattagatattaattagacaataagtgattgtaaagcacttagaaaataaaagtgtttataaataccaccaagtaatagcaacaatcattctttactgactacacagctgctaatgtcaataagaatgatttattccagctaagggcaactttaatttatgcaaaaaaccctgccgtcatatttgttttgctagagcaaaacaaaatatatcatatatacaactgattttatcagcatttaaataatacatcttgttttgattttaaaaatatctcttttaagaccttcttaaacacaggtgcaatgactggtgtccttgagtgctaagaatattggagctgggcctggcgcagtggctcacgcctgtaatcccagcgttttgggaggccgaggttgggggatcacttgaggtcaggagtttgagacccgtctctactaaaaatacaaaaattagccgggtgtggtggcgcatgcctgtaataccagctactcgggaggctgaggcagaagaactgcttgaaccggaaggcagaggctgcagtgagccgagatcatgccactgcactccagcctgggaaacagagcaagactctgtctcaaaaaaaaaaaaaaaaaaaaaaaggaaaaaaagaaaaaaaagaatattggagctccttactgttcatctccccaaccaattgcaaatatatatttcttttaaatgtaagatgtaaaatggcattttgttagctgtattttcatgtatgcaataggtttgtcatgttgggtctgcgcagtttctccctagctccttaaaactgcacttacattcaaattttggtcacattgatgagtgaaggtcatttcttttttggttattatagaagttagaaaaagaagaaaatcaattttaataataaaacaaagcactttcattctgtcttcttgattaccacccccccccgcgaccccctgcaataatagattttgaagccctgactattttcatgtctcaccattatttttttcccctaatgggcttttttttttttttttttttttttgagatggagtttcgctcttgttgcccaggctggagtgcaatgacgcgatcttggctcactgcagcctccgcctcccgtgttcaagcaattctcctgcctcagcgccccgagtagctgggattacaggcgcctgccaccagtcggctaattttttttttttttttttgtatttttagtagagacggggttttgccatgttggccaggcttgtctggaactcctggcctcaggtgatccacctgccttggcctccccctaatggcctttataggtcatagacctgaatcagccgagctcttgacccactggtgtccctggaaatgcaactgtgttttgttttgtttttgacacagggtctcactctgtcacccaggctggagtgcaatagcacaatcttggctcactgcaaccctccgccttccaggttcaagtgattctcctgcctcagcctcctgagtagctgggattacagatgtccgccaccacgcctggctaatttttgtatttttagtagagacagaatttcaccatgttgaccaggctgtctttgaactcctgacctcaggtgatccgcccacctcggcctcccaaattgttgggactacaggcgtgagccactgcacttggccgcaactgtgtttatttttcttgtcattagtaaattcaagatttaaaatgagtccaaatccacggttgcacaaatatgaaatgaactgaatgaataaaagtaaagagtgcttcatgtacatgaattcaatagaaaaggggttaaggggttatattagatgatgagatctgcatgagttagctcagcaggcttgttaataaagcaaatctaactactgtgtatcacacaatgaggcagcgtggtttggtggaaaacagtgttgaactttgattcaagagacctggattcaagtgatacttctaccacttactatgtgaccatggtcaaatcacttaactgctctgaatttgttcattcatttgaaatttttcagtataaaaacatgtcagtctcatagtgttattataagtcaatgtgtaaaagcaccaagggaggggtgaaacgctttctactgaaaaatatttttactactataattttcctggaatgggtggaaaggatttatgtatggatttcattacttagtatggtagagtattttcctgtactattaggcccagaccttaagccacatgtggacaactgggaaagtggctcaaaacagagacataaaagtagcaaaattccataggaggtaataatgctttctgggaaatctgaaattcttctgtcatctttaccccgtgttttccatctcccttcctcccttccttcttcatgatacatttctttttttttttttttttttttttgagacagggtcttactctgtcatctaggttggagtgcactggcgcaatctcggctcactgcaacctctgcctaccaggttcaagcaatcctgcctcagcccccagagcagctggaactacaggtacatgctaccatgcctggctcatgtttttgtatttttagtagagaccaggttttgccatgttacccagtctggtctcgaactcctgggctccagctatccacctgcctcggcctcccaaagtgctaggattacaggtgtgagtcacgccaccccgccataaatttcttgtttggtaaatctggggcagtgagaagaaaatgaataaaaaaggaaacgtgggccaggcgcggtggctcacgcctgtaatcccagcactttgggaggccgaggcaggcggatcacaaggtcaggagttcgagaccagcctggccaatatggtgaaaccccccgtatctcctaacaatacaaaaaaattagctgagcgtggtggcgcatgcctgtaatcccagctacttgggaggctgaggcaggagaattgcttgaacctgggaggcagaggttgcagtgagccgagattgcaccacactgcactccagcctgggcaacagagtgagactccatctcaaaaaaaaaaaaaaaaaaaagaaagaaagaaagaaaagaaacgtggaaggaatagtagagtcaggcctgggcatggtggctcatgcctataatcccagcactttgggaggctgaggcgggcagatcatttgaggtcaagagtttgagaccagcctggccaacatggtgaaaacccgcctctactaaaaatacaaaaaaattggctgggtgtggtggtgtgtgcctgcaatcccagctacttgggaggctgaagcaggagaatcgcttgaaaccaggaggcagaagttgcagtgagccaagatgatcacaccactacactccagcctgggtgacagagtgaagctttgtctcaaaaaaaaaaaaaagaattttatggtgggcaccttaatggtatcttgagaccttctgagatgccccataagctggctctgcaagaaagattcaagttcaagtagtttatttgggagatgatccgattccaggaaatacaggagcatgggtaagtgaaacaaggaaaggaaggcaactgataaagggtgccctgtggcaagtggaacttaatcccactgggggactctgggagttagggtagaacatgcagttcagagttatttcacttgagggctgaggaaactagggtatttatacactgacttctatcaatcattggttgagagctcttggggatatgggctgttaattttctggccctttagttctgacttaatggtggtgttgggagggcagggctttccaatggccagataaagccctcaggcagagagatgcaggtgctggcagttgacagtgggtcaggtgttgactatggtaacgtcatagtcattatggtaagtcctgaggggatttcggcagggttcagacagcatctcctccaaagagagtactttattaggttggcgcaaaagtaattgcggttttgtcattattttcaatggcaaaaactgcatttacttttgcaccaacctagtagttcttctttgcagatctttgaaaatactgttttgttttgttttaagatggagtctcctctgtcgttcaggctggagtgcagtggtgcaatgtcagctcactgacacctcctcctcctcctgggttcaagcgattctactgcctcagcctcccgagtagctgggattacaggcatgtgccaccacgcctaactaattttctgtgtttttaatagagactgggtttcatcatgttggccaggctggtcttgaactcctgacctcaagtgatctgcccgcctcagcctcccaaagtgctgggattacaggcatgagccaccgtgcctggccgaaaataatgttttcaacaatttgatgacgttgatgtgaggactgcttgtaggaaggtagatgtcatttgtaggtgtgttccaagctgaagttaaggtctctatggcttggcttcctcatcttcaaagtggggcaactatacctatctgattgggtgttgtcagggctataggtaggctatgataagcattaggttggtgcaaaaataattgcggttttttgtcattactttttttttttttgagacggagtttcgctcttgtcgcccaggctggagtgcaatggtgtgatttctgctcactgcaacctccgcctcctgggttcaagcgattctcctgcctcagcctccttagtagatgggattacaggcgcccaccaacacgcttggctaatttttgtatttttagtagggacggggattcgctatgttggctaggctggtcttgaactcctgacctcaggtgatccgcccgccttggcctcccaaaatattgggattataggcgtgagccaccacgcatggcctgtcattacttttaatggtaaaaactgcaattacttttgcaccaacctaataccatagtgctaaagacataagaggtactcaataaacagtagaaataatcatgatagtccttgttagggacagcactgatctgacaagttctcacagaaggcatgctcttcttgtagaggtcatgggactcagaagccctgttcctaaacattctctgggacttttctgaacagcctacctccaacatgtttcctctgcctctgctaactggagataggactttaggactttgctccagctttgttcctcggtttcagcttttttgtttcctctcactgaggtctgtgcatctttctatttgctcatgagctaaccatgcctgtctcaccccaaccctaatacccagctcttgatgactttggggaggacagtaatgttcattgtttttttctaattataagactaatatagggttggtgcggtgcctcatgcttgtaatctcagcaatttgggaggccgaggcaggcagatcgcttgagctcaggagttcaagaccagcctgggcaacatggtgaaacaccatctctacaaaaaattagccaggcgtggttgcgtgtcctgtagtcccagctacctggaaggctgaggtgggaggatcacctgagtctgggaggtcgaggctgctgtgatcacgtgactgcactccagtctgggcaacagagtgagaccctgtctcaaaaaaaaaaagaataatatatgctcatttttgaatatatatatatatatatatatatatatatatatatatatatttttttttttttttttttgagatggcatctcgctctgttgcccaggctggagtgcaatggcgtgatctcggctcactgcaacctccgcctccgaggttcaagcgattctcctgcctcagcctccagagtagctgggactacagattcctgccaacacgcccagctaatttttatatttttaaaatagacggggtttcactgtttggccaggatggtctcgatctcttgacctcatgatccacccacctcagcctcccaaagtgctgggattacaggcgtgagccaccgcgcccagccttgaatatttgttaaaggcagaaaaatttgttttaaagtaaaacaaaaatcttccataaccccacagtttaaagatttcacttttagcatcttgatatatttccttccaatgcttttttctgtgcatgtacatatgacataattgggctcatgtttttggaatcacattttgcagcctgcttttctaacactataatgctaacacgtgcccataacattagaatttcttcaaaaacatgactcttagtgagtgtacaatactatattatatggacttatttttatttgaactattcctactattgctgtaagttgtatcttttttgccttttataaataattctgcattaagcatctttgtacataattatttgtgtgcttctctatttcttttgggataaattaccaagtggaatccctaggtcaaagggtatgaatattctaaaggctgttagcatatactgacaaatatcctctatggaatttctaatgaagttaacacatgcatggattttttgaaatcattaccataatcaagatacataatgattcttggacggccacagtggctcacgcctataatcctagcactttgggaggccgaggaaggtgaatcacttgaggccagaagttccagaccagcctgggcaacacagtgaaaccctgtctctaccaaaaatatagaaagattagacaggagtggtggcatacacctgtggtcccagatacttgggaggctcaggtgggaggatcgcttgagcctgggagacagaggttgcagtgagctgagattgcaccactgcattccagcctggcaacagagtaagatcctgtctgaaaaaaaaaaaaaaaaaaaaagctacataataattccattaccccaataaactctctcctgctatcccttcatagtcatccccttcataacccttatggaatatttagctctgtagtgtggaattaactgatcattcttagctaattgtcttgatagcattacaatgcccccaagttaaaataactcactcaagtattatcaagaagtttctgagtcaggttgtagcagctgccaggactggtctccaaagtgggtggatctgttaaggactcctctcagagtggtgcctgaaagagcctatttctgccattaagactgcaagacatgctgagattcaatcacaggactgtggggagaggagcaggaagaagccaggactaggctggagcagaattagtgggaatggaattagttatagagctgaccctcagggcagttagacagaagtctaaatttcaaagttcaaggacttgggatgagtaagtgtcaggtgtgacggacttagcacaaagtagcactgaaagctaaggatttgatgtgggtaatacaatgaagatatcctaggcaaaggcagtatcttggttcaatgggacaggggaggattaggaggagaagaaggtgaggaagggagacagaagatattgggagtctaaaggaatggcctaggctcttggacaagagttcacaaggactcagctagacatcagaactctttaaaatgagcaggtgaacaggtgaacctctcattctggagagagaattaggtgaccaattaggaaccaaggggtggctcagtggccaagaatacagtggggtttaggtgctttccaatgtgaacagtgactctaaggtagtggtttgtaaactttagcgtgggtcagaatgcctcccaaaccaggaggttttgattcagtaggtctggagtgggaagccagaatttctgattcagtaggtctggggtggggatccagaatttctgacaagtgaccagggctgctgctgcacttcttggagaagtacactttgagaaccactgctctaaggcaaaaatacatatattgagattagaataaccatgtcatttgcacgtcacccagtacacgtaggaaaagggctcctaaatgtaacacagggcttggctcttccaggtgatgagctggtagagttaaacctgctgctggaagtgttttgtgcttccaggagggcaaatagggtaggaagcatcactggaattctcacaacactggagttctgtcctgtataggtcataatactcttaagtgatgttattctgacttaaagggccagcatctaaaactgtcaaactgtaattctctgctacagaatccattttcttcttcttttaggactagccctctttgcttattgaggagtaataaaaataatgtccccttatattagcatagcacgttctaattcaaaaagtgcaatgacatgatatctcatttgatctcctttctgtgatggaggcaagcccggtatttttatcccatcctttgggctactgattctcaaagtatagttcccagacctgcagcattaacaacacccagaaactctctagaaaagcaaattctgaccccaccccagacttactgaatcaggtccggggtctggcagggggccaataattcgcatttctaacaagttccctggtgatgctgatgttggtgctgctggtcccagaccacacttgaatgaaaaccactactgtagataaaaatgaaagatgtagaagcccagggacttgtcctaagaggactcctgcctagatccttttcttactacacctgctgcatccctggtccctacgcgcccgcccccaccacctcgcccttcgcaaaaaaaaaaaaaaaaaaaaaaaaaattccttcaaatcccagctgcattattttagaattttgtgaatgtgaatacctgtaaaatgaggataacaataggatctacctctttgggttctcacaaagattaaacaagaactaggtaaagtacttagcaccgtgcttgtgcttaataaatgccagggatcatcatgattttttattaatattaaaagtgacaattcacaatgaataccttggtaagttctttggatgtgtgtcttcagaatgctcctcttaaaatgtgaatgtccctagataatgtagacattaaagcacctgatcgttaacattccatctctgattgccatgagcatttggctgagagcagggtacttcggaaatgggacccacgactggtaaagtaggaaccaagagaaaatagagcagtgcatggaacagtgtattgaaaggcacacaacagcaagacttcttgaggaaactttgaatagctggggaaggggaagagtggctgacagaggaagcaactgcgaaagggcagccaggagtaggaggcaggctgttaaagacaatctacctccttcaaagttccccctagggcagccccaggggagggctccagggctacaccaggccacgaggggatctgccagggttcacgttgcatgaagtccaggggtcgaacactcaggtgcccatagtgaatgcccggaggggccctccactggcaattagcacaatgaatttgggctcaaaagtggctttgtcttcagggtgactcctatttggcaaatatcctgactacagcacatcatgcactagctcatcccagggacatggtcctttattagtggaggtctgctatgttgtttctcaaggcgtcctaggcccctcaggaagcggttttatgttatctgggtggcgcagcccgggtcccgtgcccagagaggacggagacctttgcaactgaattaaacagaagaaacaaaagcagcaagttcgggcccgtgggtacggagggctagccaatggggcccggccgcttcccggcggagtggtactatgatgacagtagccaaccagcgcgctctatgcaaatgagatactgtatcccgcaccagccgcttcagtgtcgtctggttgttatagtgataaactgaggccttgcctcttggcttctgggagagagagagagagagaggggcggggggtaacctctttacttcccctagggaagacagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactggtaagtaaagacaaaggatggaaatgtatgcgtggctatggcataaaagagttccttatgcgcccgcagccagcgaggaaaacgatgcttagaggattttcatgtaaatgagaagagcgctaccgcctaatccttctcagctgtttatacttagcttctataccgggcgctgctctcagtttacaaagcgttattgtattggctgggtaggaaacgggctgcttgggatatgctgtgtttttgtgcttcgggaggaggggagggcctttttccttttaggtgtgttcttgtctgaaggtaaaaaaatcctacagtgcaattttaaaatggtattctctttaccaagctcgggaagagtcccttgttaagttttaaattctagctaaggaatgcttcgttcctcaactgattttggtgcctaatgccaatttggggggaaaaaaatggaaacatggaagcaaaacttccccatccgtttgaaaatgttcaaaataaataaataaataaatacataggagtccctcaatgatttagttagaaataatacgcatttaaaacgaattgtaaaacatttccagagtgtgctgtgagggtttctcttcaggtagtggaaacctggggagctacatttatttagaaaggggttgcatgcctttaagaatgaaagtgtggaaacggggtactgagagcgtccttccgcctccgtaactgcaccgtaactgctctcccaaatttggtcgtctctctatccctggtcatgatcttttaggtagatgtgaaacttcgttcccaaccacctcagcatgtgtcctcaaggaatcaaaaacacgcatgggtggtgggttttctgtggtccgaagtcttgtggaacttggggagacctctctttgagtcccccaatccaaaagacacactagttaaagctatcctttcctttagcgatttccctcaagttaaaaggtggaatattttgattggctgtggagtttgaccctgggaagagttttttaaaaaaggattttgtgatgtagcattttctgtgaacctgcaaaattagggctcgcagatgagaaggccaacccatcataaaactgttatttcttaataagagttaataagggttcaaaggaggcttagaacaacttcctaaaaagcacaaatacagaggaagttatattagagccctgtgggcttttttcccctatgcttctatttttaaaaatgttttctcttagggcagtttaatagtaactgtgccctagcactttagccacttactgaatgacatacacagtgcagtgtctatgttctcatgagatacaaaccatcccaataagtttgttactaagggattcctttgagtcactaaacaacttatggtttagcataaaggaaaatgaccactaaaagcatattacaagattatcatatgcacatatacatatatacacataaatagagagagagactcactctgttttccaggctggcctcaaacttgaactcctggactcaagtgatcctcctgcctcagcctcccaagtagctgggattacaggcttgtgccacagcactggaccaatatatatatgtgtgtatatatatatatgtatatacacacatatatacatatatacacacatatgtatatatatttgtgcccatgcttacccaaaaatatattttttaaagtaaccacaatcttcaaatttgcatcacataccttcctgacagaggtaaagggcagaggagagaaaggcggcatccagctccagtttgtgcatcatttcagtctcttttgcctactatttttccttccatttttacctcttagctattctgcttcttgattgcttctgcctgagggagatgggcagagaaaattaagggaaagaagaaagttcaagttactttcttgtttttttaagatggagtctcactatgtcctccaggctagagtgcagtggcctgatcttggctcaccacaacctccacctcccaggttcaagcgattctcctgcctcagcctcctgagtagctgggattacaggtgggcagcaccatgcctggctaatatttttttgtatttttggtagagacggggttttgccatgttggccaggctggtctcgaactcctgccctcaggtgatccgcccaccttggcctccaaagtattgggattacaggtgtgacccactgcacctggccaagttactttccactttcactcgtgacagcttattccaggtggtaactcacaagaaccacgcaaagctggcaatgtgctctacaccctcacctcccacccattgtagaaataaggaaactgaggttcagagagggtaagtgacttgcccaagggtcacactgctttgaagggggcagagctgggatttgaacccagagctctacaccggaaaagtggaagatctttcttctataacatactcataagtgagatacattcccttcccatctttttggcagttctggtttcgtgtgtgtgtgtgtgtgtgtgtgtgtgtgtgtgtgtgtgtatcatgcacatgcataggtatgatacagatgtacataagttgaactgttgaagcacctgctttgatttacttatgatacaaaattttccacgttgttcatcattgtcatgggctactgaaatttgactctgtttaaacaggggcttgcaaccaatttataaaacactactaaaattttcaaattgccttctctcttattagctaactttgatcactgtagggttatattctaaatttagatttatactttatagcctaactttcctttgctaatgatcttactttaataactaaggcacatgctaactacttaataaaaaagtttgttgatgaagagagtgagcagcaagtgaaaacatgaaattagcatttctttctctggtttttagtagtttctgttgatcttgtagctttgctagtgtcttcatatttcaaattgtataaattctgcatttctcccagcacccaggcatatagctccaaattgtatgtgggtcactgacaccacagccatcaacagagtgtggctactgagttgcttaactaactatggaaagtgtatgaaatatttgcagggggcctgtttaggattgaagctccacacttggattctccttcagagggcaggctccttctcctagttgctgaaatgaagtggggagctggcatacgtgagtgaataaatagactttaaagcagtctatattttagatccctgtaagtaacaaattgataataatattgcagatatgattgaattatatttcaaggggaagttcttctgccaggaaaacttgtagtttctctacctgccttattcttcattagaggaaaatataagaaaggagacgattaaatagaatgcagtaactctgataaagaaattagaaaagaaataacaaaagcattacctaggttttatgatagagcctatattttaggaatataatcttactactcttaccattttaccatggtgctctgatttgagatgcttctgagaactctttacattgttacaatgtttactcttgattcttgacttgttttcagttctttactattttcctgattaaacatgatgcaaggtgactcatcagcttgactgtcaagatgagaaactgagtggccttgggtgatatgatgtaatagcccttcttggaaatctaactcctgagatacaaggactcctctgagcaaggactgtgtcctcatatcttcccagccctcagattatgcctagaaagatcctctgggctcagcaggtgtcccagaagccctttctaacaaggcccagccaccctgaaagttgtctgcttgagaatttggttaatgaccttggacaagttcttctaggggtgcattctgttgtcagaaggaattgtaattctagactgcaatagtcacttccatgaagatggatatactatggatcaactgagaaggccttggaaataaaaaagggttggttcaacatgccacattagcaggaggagttcatttcgggttttacttcaaagtggagcagtgccaagagactgctgtcttgcagaaggtgcattatgtcagtttggaggtagcatgctcatctgctagtattcaaaaagatgaccagatttccagagacatcaatggcttcctttgctaatattgccatctacttagccacccagaacagcatacattttaaaagtgaaacactcttaatgcgcaatattggcgaaaataaacaaacgtgagcttccttgggtatttactgtggtcaactggaattctgcctaaggttattattaggtatcttcctgctggtctctatccaaatgcaacatccatgtcttgcaaattgatactagtcaggtgtatttagcatggaatcaatcaattagtttcttccattcttttaggtttgttctctcactacccctccaacccaatttgcctaatgctaaacccttatggaagaaataaacctaaatcaaatataataggtagcttctgtgttttattttgatgatttagcatatagaaatcaaaagagtgcatgtatatgtcctcaatcaggcagtgaggaagatttaaagtatttagcaatgcagagttttggaagataactgagagaaaactgagtctcttaccaatccttaccaacccctaccatccccttacccatgggatccacagtcagccaggtggttaacaacttccagacacagcaatgcaccaggtgctgtggagagaaataaaagaagtgaatccaaaccccttgcccctaaaggggcatttccgtttaatagaaggtagtagtttggtttgtggaagcatgccaggatgctgaaatcccttaagagagcttttttgtaagtttgactttaacatattagactttcttaaaagctattttttatccattgaggggaagtacttcccagcagggaggactctgttaacccaatccccaagttaagaaaagtccctgcatttgaagaaaaggttttacttgctcaccccaatacatattttgggacatggaaaggatcaatccatttttgagtggatcttaagcccccattgtgggtcacatactggcctagaactctagaacagctctgcccagtagaaatacagcatgagccacatgtgtaattgaaaattttcaagtggccacagttttaaaggttaaaaaaggtgaaattaattttgtatccaaaatattatgtcagcatgcaatataaaaattattaatgagatcttatattattttcttcatactaagtctgaaatccaatgtgtatattgtgcttgcaatacatctcaattcggactagctaatttcaagtgctcagtgactacatgtggctttacagggagcttagacacttgtccagccctgttaggatcagttctgaggacctacaatgataaatacttttcatgttgcacagttcacgtatacatatatgtagtcataactaaaaccaaacatcacttttccttacttcatgttttgcactcttatactttctatgctatcctatcttattctatttcagttaagagactgttgcagtaatctagatgagagttaataagtttgaaattatagaaggacagtgggaaaggagagaactagatggatatgggaaacactaaagagataaatgccccaagatttgataactaagtctgagcatggggcaggttcagtgaaagatcaaggggccaggcgcagtggcttatgcctgtgatcccagcactttgggaggtgaggcaggtggaccacttgaggtcaggagttcaagaccagcctggccaacctggtgaaaacccatctctactaaaaatacaaaaattagccgggtatggtagtgtgctcctgtaatcccagctacttgggaggctgaggcaggagaatcgcttgaacccgggagacggaggttgcagtgagccgagatcatccctctgcactccagcctgagtgacagagcgagactccatctcaaaaaaacaaaaagatcaaggaaggcacagtttgttttctggctccaactagtgagtgccatcactgagatgggtgtgccagggaagtagagtttgtgagagttatgtctgaggtgccatggggacttccacttggaggtgtctagttcatgtttggttggggaactcaggagagagttctgagctggagatatagatctgggagatagcatggaggagatggaagtgaaattgaggcagtgaaatggatgagagtgaaattgagatagtttctggactgagaaggaagtggatggagatggttacctaggaagagtgcctcaggataatcccactacagggctaattctagaaagtaactgaccctgagccatcctatcaggttcttagagggggaaaatagaggagctgtaattaaagctattagactcctccttctattcatctgtctctacatgaaatctggttaagctaatctactttatcccagaatcttcccaggttggaaccctaagaaagactacttaaagggccaatagaagaaggatcatgaaaagaagacagagaagtatttctcaaataactgggagatcaagggaccaagggcagggtaagtttcatggagggaatgtccaatagaatcaaatgcagtagagagatcaaatgagttaaggaggaaaagtttcctttggatttagaaagaagaggtcagtggtgatgtttcagtgaagtggtgggagcggaggctggatggcagtagattgaggagcctataggtggtagggaagtggaagcttgactgagagaggaagcagatagaatgtacagtacccagaggtggacaaatcagggcttagggttactagagactagcttttccccttccttctttcgttcctttcatcttccctcccttcatctttttttccttttatttctcattcctttcatccatccaagatgtcagatcttttggttggctcattcttttaagatgatagcaacttgtgcctaaatataaatgggaaagagccagtgggagagggaaggggcgatggtgatggggacaactgatgaagggaatgtctcttaggctggacaggttgggctccagtgcacaagtggaaggattggcttcagggagaaaaaaagacacctctcccactgtagtggcaaggaagctggcaaggatggtttgggcaagaacaagttataagaggaagggtactgaaagttgaaggcctctctatctgatagcctgtttttcatctgtgaaggtggaagcaaaatcatggtggcttatttctggctagtacggaactataattctggtatatcctgggtagttgagtccagccccaggatatgtcctctcctgaggcctccaggctgtgggtagggagaagtggaaaggctgagatggttcctgatgagatgcagtgatgagagcaaatggatctgcttcgttgtggcctctgggactccacaccaatgcccatcaagccaagtctagatctggccagggagagctgaactagcccacggtgaaaggacagggggctgtcaagacaaatgtgctaaagcttggtctggacttgctggagcccatagtcttgttccagtgtcagttttgccattgaattattgtgtgcacttaagcaaatcactttcctctctggattccattctgtccccgacaatggattggatagatccttagagtgtgattctagctttcattgccttggaacttggtctactgcagtatgttctgtttgagctcatgctcctatcaaaagtctgggctaccccattcctcaccccctgttggttttatccatttggggtaaaaacaggttgcatgatcttatggtaagacacactggctaaatatgaataacaaatgttcacaagcactttgaagttttacattgatgttgtacaaaccacttctgctgtcttctgttttattcttcagatgctttctcagacaggttgaatgtattccaaatcatatatggaatgttctattcattgtttcgggaaacctgtgttgaatctcttcttaatgtgaacagtagcctcctaatttatctatttcatactacagaagtttgaaacattgggccttctttgaggcatggcagtatgggcttgaactatagaggcctttcttaatcaatgttgtccatctaagcttgctacttggggttaaagtccagcaatgggtcaggctgtagtcccaaaactcttacatctttagctggtgccccacacaaagcttctcagtgactgttagggaaataaatgcaggaaaataattatcccatcagatcactggggggaagaatgaaaaggaaaaaaaagcaaggaaggtagaaacaaactaagtcattgcaagctaggcctattttcttccaataatctcccaggtaacagcctctaccttgctaggatctgattacccgttgctggcctcagaccatagcattattgttttaacattcctaccttcctctttatcccagcatgaactgggttgtatgggaggctgggaagctgaccttgcttggggataaagagacagtttagcactcaacaatcttgaaggcagacttgaaaacacagtgattagaaaataaagcagtgagccctggtagtgtgcgcctgtgtaatagtgtgcagggccacacggggctagcctattgagcagaattcattttcatataatctcctccctcccgccaaaatctttgacttggtgtttttgttttctactcggtaattcatgcatgctgaacctgacatcaggatgctgagggttatttaaactgtcatttaagaaaaataacaacggtaataggttaatagaaacatcatgaatgatgtgtacagcctattgccaaccaaatgatgttgaaagcccattcctggtacatgcaggcttctgtgtttcatctctggtgtgcctaatattgactgtaggcacagtcacataataataaattctattgtacctccaaattgtttagttataaggtaattgttctatatgggatgcaaggctagtggtctcactcctttttctccatgggcaagtcggggaattgaacaaccattcacagtgcacactgtattgggcactgtgttgaatgctctatatgtattatctcatttaatcaggctgcagacccatgaaataagcattactattcctcatgttataagtaaggaaataaataatcaagtaatttcccaaagatccaaaaagatacatatgtatatttttgagatgaagtcttgctctgtcacccaggctgggtgcagtggcatgatctcagctcactgcaacctccgcctcccaggttcaagtgattcttctgcctcagcctccccagtagctgggattacaggtgcacgccaccacgctcagctaatttatatatatatatatatatatttttttttttttagtagagatggggtttcaccatgttggccaggatggtcttgaagtcctgacctcaagtgaccctcccgcctcggcctcccaaagtgctaggattacaggcgtgagccaccgtgcccggccccaaagatcaaatattaactgattaagctgggagttgaaattaggtttgtctgacttctaaagcccctatttccatgacacatagttcacaaacttcagtgagcagagaattgcctgctcaagctcccaggtgattcggaagcaagatgtgcctagatgcacttttagagatgctttatttagccctcccagtcatatctgctgtgtttgggaacaggagtagaaataaatcagatatctgtgttctttgtagtaaaactagaaattcaatgtaaatattttgacccagcagttgcattcctaagaaatttgtacacatggccaccaaaaaaactagtattaggatgttcttagcagtgttattcataataaccccaaactggaaactacccaaatgcccagcagaagcagaatggattaaaaaaattgtagtacactcacacaatttaatgctgggtagcagtgagattgaagaatctacaaccacctgcaggaatatggatgaatctcacaaatgtaacattgaatgaaagaagccagatacaaactaatatgcgccacatgatttcatttctataaaatataaaataaaataggcaaagctcatctttgatgttagaaatcggtgtagtggtaggagcatgggatggacgctggaagtgttaggttacgtgatatgtggctgtgtgtacttagcttgtgaaagtccattgagctgcacttaggatatgtgtacttttcttttctttgagacagagtctcactctcacccaggctggagtgcaatcgtgcaatcttggctcactgcaacctccgcctcccagttacaagcggttcttctgcctcagcctcttgagtagctgggattacaggcatgtgccaccacacccagctaatttttgtatttttagtagagaccaggtttcaccatgttggccagcctggtcttgaactcctgacctcaggtgatccacctgcctcggcctcccaaagtgctgggattagaggcatgagccactgttcctggctgatatgtgtacttctctataagtctattattctttagtgcaaagtttaaagatattattattcacaataatgaagaaagggaacactctacattgtatttcccatttccaaataattctggtgatctaataaactctaaggaaaggcatcacatcctacttacaattatagctcttggctgctaacagagcttcaaagtgctcagcccttccaggggccagtatatccagccccaaagagagtctagtgagcacttgaacgaaacaccttatgtctaggaccagtccagccctagtcaggtaatctgtgaattaaaatccgtggcccccaattgtgtactatgcctggcctcacagtcagacaggttgtgggctgaggaaatggatggcattggttaggtagcaagagtacctcagaataaccctgctacagggtgaattctagaaaatagctgacccagagcctttgcatcagggtttgggaaggggaaaaatagaagagctgtaattaaagcttttagaatcctccttttatctgcctattgctacaggaaatctggttaaattaatctactttaccccacagtcttccaggatggaaccctgagtgacaacatttagagatccaatagacaaagagtcaggaaaagaagacagagagtacttctcaaataggtgggagatcagaggtccaagggtaaagcaatcaccttactggtagttacagttttcttgtaaaatatggtttctgttaaagaaatcatccactttgcagaaaatatcatctttggaacatctttcctttagtgactcagaaaaaaagaggttttattattgaaatagaatctagcaaatacctcaagctgagacatgttagaaatatctgtacttctatccaagtatattgcaaacctcccacactgcataatttgttctaatgcttgtttctttcaatcttcaacaatgttttctatatgtcttctaaatatatttgctgacaaaggaatgcattttagtttgacatcagtttttttttctacacattagagcagctagttttactgtagcatgaagaatagatgattttgcaatggtatgagacttttgttttttctctattgagttatggaaactcaaaaaggcttctaaacatttatcgttacatgtaacagtattttgtgacatgctggattgagtatcacatgactcacaacattgaaacattaaacatggaaaaatcatagaggtttatcttcatgttctggatgcttcattttaaaatatgttaattacaataacttcataccatcattagctaatatctcaaggtgatatttaatgttattggtagcagatatttctaatggtcttctgtgagataattttcaattcagctatcttcttgtcagatcagattgggttgtcgtggttggtacctgataatgtggtggctgcagaacttttacagggagtagaagggtcagctctgccattttcttgttgttcacttgtgtttgcattatctttgctttcctatttcattgcaggaaatgtttttgttgttgttgttgttgtttgtttgtttttgagatggagtctcactctgtccccagcctggagtgcggtggcgtgatcttggctcagtacaacctctgcctcccaggtacaagcgattctcttgcctcagcctcccaagtagctgggactacaggcatgcaccatcatgcctggctaatttttgtatttttagtagagacggggtttcaccatgttggtcaggctggtcttgaactcctgacctcgtgatccgcctgcctcagcctctcaaagtgctgggattataggcgtgagccaccgcgcacggcctgcaggaaatgttttaagccacctgctgatttatgtgcattggtttagttaaaactagataatataatccacaaatacctttatctaggctcaggtgaactgcagtatattgcaataagctgaaagcaaatgaaaaaatgtcaggcgatgcaggccacccaactttcacattccctttaggatacctcatgtatttgatgtggacagaaatggggcaccagtgtaaacccatatatcagaattagaaggccaggcgtcatggctcatgcctgtaattccaacacttcgggacactgaggtggaaagatcacttgagcctaggagttccagaccatcctgggcaacatagtaagacactatctctacaaaatttttttttttaattagatgagcatggtggtatgtgcctgtagtcctaggaggctgacgcaagaggatcgcttgtacttaggagttggagggcgcagtgagtggtgatggtgccaccgcacttcaacttgggtgacagagtgagatcctgtctcaaaacaagcaaacaaaaatagatatttttcttggtttttgtaaagctttttttcttattttttgacatgaaaaataaatacagtaagtcctcacataacattatcaagaggttcttgggaactgtaactttaagcaaaatgatgtggaatgaaaccagttttaacataggctaatttatgtaaacaagagttaagttcgtatggcgtatttctggccacaacaacatcaccaaacttctttttaaaattttttattgatatatatactgagacggagtctcgctctgttgcccaggctggagtgcaatggtgtgatctcggctcactgcaacctccatctcctaggttcaagtgattctctcacctcagcctccggagtagctgggattacaggcgcatgtaacgacgcccggctaatttttgtattttttagtagagacggtgttcaccatgttggccaggctggtgtagaactcctgacctcaagtggcctgccctcctcggcctcccaaagtgctgggattacaggtgtgagccaccgtgcctggcctgattacattatatttgtatatacttaatggggtacatgtgaaattttgttacatgcatagaatgtgtaatgatcaagccagggtatttagggtgtccatcaccttgagtatttatcatttctatgtattgagaacatttcaaatcttgttttctagcttttttttttttttttttttttttgagacatagtcttgccctgttgcccaggctggagtgcagtggtatgatcttggctcagtgcaaactccgcctcccaggttcaagtgattctcttgcctcagcctcctgagtagctgggattacaggcacgtgccaccacacccagctcatttttgtatttttagtagagacccggtttcaccatgttggtcaggctggtctcgaactcctgacctcaggtgatccacccaccttggcctcccaaagtgttgggattacaggcgtgagccaccgtgcccggccacttttcaagctattttgaaatatataatacattgttgttaactataatcatcctactctgctatcaaacattagaatttattccttctatctaactgtatgtttgtacccagtaaccaacctctcttcatccctagccccgctcacccacacacacttcccagccactatctcaatgatagtggtatctatcattccactctctacctccatatgatcaacttgtttagctcccacttatgagtgagaacatgcagtatttgtctttctatacctggcttaagtggctctgaaaagagcctttgctttttgaaagtagaagttgttcacttggagctggtgtacttggtgagggccttggtgttgtgagacacagtgtgattggccatctccctaggcagcaggcacaagctgtatggatctccctggaggtgatcgtcgagtacttgtaatgcatcaggaatgatgcacttgaagatattgacaaatgagttcatgatgcccatggccttcgatgagatgccagagttgagatggacctgcttcaataccttgtaaatgtagatagagtagctttccttgtggctatgcttgtgattcttgccatccttctggctcttggtcacaccaccttcttggcacccttctttggagcaggaacagacttggctgattcaggcatgtcaccacaaatcaataactatactgagaaagaagccacttcaacaccaccacacttctaaataaagaccaaaacactgctagtatcattcaacattgaaatacatgtgagctatgtatacatttaagaaagactaataaaaacaagataattatttgccagcttattccagttcagggtaatgggtgactgggacctatcctggcacctcagggcacctggtgggaaccagacctgaacaggacaccatcccatcgcagggcacactcacacacacaacacattcataacactgggacaattttttttttttttgagacagtcttgctctgtcacccaggctggagtgcagtggtgcaatcccggctcactgcaacctccccctcccgagtagctgggattacaggcatgcgccaccgtgcccagctaatttttgtattttagtagagacagggtttcaccatgttggccaggctggcctcaaactcctgacctcaggtgatccgcccgccttggcctcccaaagtgctggaattacaggcgtgagccactgcgcccagcccacattgggacaatttaaagacactaattaacctgctgtgtacatctttgggatgtgggaggaaaccagagtacccagagaaaacccacacagatatgaggagaatgcgaaaatgcttcacggacagtagccctgacctggaaccaaaatattttttttttctcatccacgttataatgaaaggtcatcgaacaaaatgacattattcaaggatctgaggtataaacacaagtgttgctgtctaatggattgtcttgcccatcccacattagaaaacattggtttaggcattctaaatcttaccattggatccaaccatcagggagaaaaaaactgtattttcagggtgcacgttcgtttggccccttaaagaaaatgcttttctgaaccgctttttggtgctggggttctgccttacatggaaggcactatggagacaaacataaaaaaacaggactttctggctaggcgcggtggctcacgcgtgtaatcccagcactttgggaggccgaggcaggcggatcacgaggtcaggagatcaagaccatcctggccaacatggtgaaaccccgtctctactaaaagtacaaaaaattagccgggcatggtggcgggcacctgtaatcccagctactcaggaggctgaggcaggagaatggcgtgaacccaggaggcagagcttgcagtgagctgagatcgcgccactgcactccagcctgggcaacaatgcaagactccgtctcaaaaacaaacaagcaaacaaacaaaaacaggactttctgtactagggggctgttgttgagtgtatcagtaccgatgttactacagtattacccatcataccctttaaggtggcaccacgggaggaatttctctcagaactcagcatcaggaaaatgctgtgctttttcctcaatagctattttgctttgtgcttaaggacaacattaactttgttttcctctttgctgtgactactgggagcttaaagccatttttgtagtcttacctttttgaaatatagaggactgtgatatgcatttctttgggctcatttcacccctgacctttagaaaacaaacatattttgactgggcgtggtggctcacgcctgtaatcccagcactttgggaggccaaggcgggcggatcacgaggtcaggagatcgagaccatcctgggtgacacggtgaaaccccatctctagcaaaaatacaaaaaattagccgggcgtggtggtgggcacctgtggtcccagctactcgggaggctgaggcaggagaatggcgtgaactcagggggtggaggttgcagtgagctgagatcgcgccactgcactccagcctgggtgacagagcgagactctgtctcaaaacaaaacaaacaaacaaacaaaaaacatcaaaaaacatatttctcctcctcaccccagatcttgcaactattattttaaactttcaaattttatttttaaaatcacctcaagttctttggggaaggaggtggaatatgaatatgatataacattgttattgatgttcactataaacttaaattcaattatctaagaaaaaattatttagaatgtggaatttttatatcttggtaaagattgttttctattgttaatagcatctatgcatttaatgagtctaagaggctattcatggtaagttgcacttccatttcaatggtgttacaatgtgaaaaaatggccaacactgattttaagataatatctattgtaagatccctcctactctcagagatgctaaaatgtggggagaaatgtacattttagaatcaatgaaatgtgactttacttatagtactatgagtcttctagctatttgatattcactcactgctgtgaggttggaaagtggccgcatgagatggagtttggtttataagtggtcagtgttttaaggaagcctgtatctccagggcataataaaaattctgatctctgatcaccaaaagggcagtatgtactaagctgacctagatgtgagcattcaggcactggtttactggtttaaaaaatgaacttattatgtgggaactctaaataaagttggaaaatacgtgttgtttttttttttttttttttttttttttttttgagacagggtctcactctttcacccaggctggagtgcagtggcatgcaatcacagcttactgcaggcttgacctccggggaccaagcaatcctcccacctcagcctccagagtagctgggactacaggcgtacaccaccatgcctagctaatttttcatagagagagggtttcgccatgttgcccaggctgctctcgaactcctgaactcaggcgatctgcctgcctctgcctcccaacgagctgggattacaagcgtgagctactgagcccagcctggaaaatgtgtttttaaaagatatttaagataatttttaaactgtgctcttgttttagttttaaccaacttcaagatacttattctcaacaatagaaaaataggcaaaggacagattattctctgaagaaaatacaaatggccaataaacatttgaaaaatgttcaatctttttgtaatcaaaataatgcaaattgaaacagcatgctaccattttttggtctataaaattgacaaaggtaatactcaatgccagtgagatggcagcaagataggtgctttcatacgttgtaatgtgagtataaatgatacagcttttgtaggaggcaatttaccaatacatgttgaaatgttcttcaaatatttatctttaaaatgttcatacccctgatctaagtaattcagtttctaggcatctgttataaggaaataatcagaggttcagaattatgtttagcatgttatttatattagtaaagtataaataatttaatattcaatgatggagaagtatttaaattacggttctttttcagtgaaatgttttacagctatcaaaattagtgaggttgaaaactatttaagtgacatgataagataatcatgatatattgagtgaaaaaaactgtctatccggcaagattccaaacttgttaatatgtatatatgtcataccagaaagcctaaaatgaaatatagaaggagttaactatagttgtctctgggaagtagaaagaattattggtgacttttattttcctctcttaactttcccaaattttctataatatatattatgatgatgataagaaaaagctatgaaagattgacaaatatatttattttattattgagtttaaagtctgtatttgtctttatcaattatcattctcactcctgtgactttaaattcccccattcagcaaatattcttaaggaccttctatatgccaggtactgccctggggaatagggatatagcaatgagtagacagaccaagtccttgctttcttagagcttccctaatagcagggagagacggagcttaaatatacaatgtttcctcatctgatgacctggacctctcttctacctgcatccatgccctgagctgaatgagtgaatctagtctaatggctttatatatcacatactctctcagtttctaaacctgcatctctagcttagtcctttctcccaaacaccagacttatacatccaactgtctacctgacatctccacttggagatctaataggtgtgtcaaaccaaatctgtgagaatggaattgttaatttccccatccttgttgtccctcccacccctagacctactcttccagtgttttacccctcctagggaatggcaatgccatccttccagttcttcaggccagtagctttggaattatcctgattcctctcattctttcacaccctacatccaatctgtttcaagttttatggatccaaaatctatccagaatctgaccacttcttaccacctccgctgcgatcaccctgacccctgcctctgtcttcttttgcctgattattacaccagacacctcagtggttttcttgtttctacctttgacctcttacagtttattctcaacacattagccagatggtcttgttaaagctaagtcagatcattatcatgccttgttcaaaacgctctgatgcccagcactttggaaggctgaagcaggtagatcacctgaggtcaggcgttcgagaccagcatggcgaaaccctgtctctacttaaaatacaaaaattaggcaggtgtggtggcacacgcctgtagtcccagctagttgggaggctgaggcaggagaatctcttgaacccaggaggcggaggttgtagtgagccgagatcgcgccactgcactccaccctgggcaacagagtgagactccctctcaaaaacgaaacaaaacgaaacgctctgatggctcccatctccctagagtgaaagccagtctttacagtgtcctaaaaagctcacacgactgggtgcctctcatctcctttcttctggtctcacctctggctacatcttttcttttttgctcgcttcctccaagcatactggccttctagttattcctggaagaagccaggcatgttcatgcctcatggccttggcccttactgttttctctgccaggaatgctctttctccacatggctcacttgatcctttatatatttacacatacatcaacttctctgactatcctatttacagtgatacccccaacactccctattccctttccttgccttatttttttctataacacttaatcaccctttaactaaaatactacatgttttatgttcttttttgttgcttgtttattatttttaagtgttatgagggcaaaattttttgttttgttttgttccctgttgtatcctcagaagctagaacagtgcctggcacacagcaaggactcaaaaagtgtttgtctgatgttagaaaaatgaattacgggtagataccatgaaagtaatttaaaaattttttaaagctcaaatgagttttaaatattccatatacctgcaaatcatatcatttaacagttaatttctggataatagtttttatttttcaaaatactcctcttttcttaatatagacctccctcccccatccctgctacatttgggagacctgagccttgattaaattttctgcatctctgaatttaaaggagaggagatatttctttaaatttatttttgcattatgaacattgcatgaatgcattctcattttaaaaataaaacaaaatgacagacatatatggaataaacaatgaaatctcttcatctcttctctcaaaatattatctccttcccaagaggtaaccccaattaacaattcaatgtgtatcattcaagtccagtgctgtccagtagaactttctgtgatgatagaaatgttctatatctgcattgcccagtatagtacccagtagtcacatgggttattgagcacctgaaatgtggctaatgtgaatgacaaactacttttaattttatttaattttaattaattataatttgaatttaaatagccccatgtgactaatggctaccatattagcacagttctaaactatttctttttcttttcttttttctgtttttttgagacagagtttcactcttgtcacccaggctggagtgcagtggcgtgatctcagctcactgcaacctccgcctcccaagttcaagcaattctcctgcctcagccttccaagtagctgggattacaggtgtgtgccatcagacccggctaatttttgtatttttagtagaaatagggtttcaccatgttggccaggctggtcttgaactcctgacctcaggcgatccacctgccttggcctcccaaagtgctgggattacaggcatgagccaccgcgcctgtccctaaactatttctacacaattacctctctcttttcttctttttctctctcttcccccttctctctctttttactataaatgacatcatactagatagcatgtatacatacatattatacatattgctttgtgacttgctttttgcattcaacaaaatgtcttagatataattccctgtcagtacatacgtatctgtcttgctgttttcaatggtgcctgttacttataacatgtacattccatacataactaaatgaaaaaaatggatatttcttggtgctgaaccacatactgggcctcttttttcttctctccagtgacatttattggtgatgactttgcaccagctgcctgatttaagagtctacataatcagtgacacagtctaagaatccagtgattcgtgtgtgttgggcccatggttaactatattatctatttttttctgtcctctctatcttcaaaagacaaaatattctgactccacaataaataaggttttaaaaatatgttcagaaacaagtaaatataaacctaacagtatgaggctgctggattagattttgtgatgtctttttgtaattctgaatttgtggttctaaagctgatgagtttcacagcaaaaggcctacctggaagaagtagattctttctgaagtcctgttcttatctttttttgcatatcctgattaaaatgttctgtctttgtaaaattcttttctaccagagacattcttgagatggttataactttagttactctgggtaattcacttttcaattgatttctatgcttctaacatacctcatcagcattttctagctaatgtttgagcctgacaaactgttatagacacggtattaaccaaggctctgtcaagacacagatggctcactctaaaggtgaaattgaaagagagtttaataaaggtaatacttacaaaggtatgggcagggtttaaggaaacctcaaggaatagtatagtatccttggcctagaaacaatgggggattgccatcccccaggctggtaggggcaaggggtgagtgtggttaccagaacctcacacagacagctctataaagaggaccccctcacagaagctgtgaattttggtaaaaggacagaaccaacacactgcttcctagcagagaggaagccagggagacaaataccctgagctcactcttgtcctgacctccactgttttgcacgcttcccaaccaactggaagcaggaggcagagatcccattggtgcagtccattggggaagccatacagaaaagagtagaggaaaagcatagagaagggtagaaagagagtggattctggagaggcaaaagggaagatatttattacccacacattcttttagttaatcctcacaacagcttatcctcctttcataaacaaggatactaaggcttgagaggttaagaaccagcaatttgctaaaaatcaaatgtaaaaataggaaagggatattaaataatggaggtaggatttgaactcaggcctgtctgacgggattgccccactggagttaagaatagcttagcttggccgggcgcggtggctcatgcctgtaatcccagcactttgggaggccaaggcgggcggatcacgaggtcaggagatcaagaccatcctggttaacacagtgaaaccctgtctctactaaaaatacaaaaaattagccgggtgtggtggcgggctcctgtagtcccagctacttgggaggctgaggcaggagaatggcatgaacccgggaagtggagcttgcagtgagcagattgcgccactgcactccagcctgggcgacagagcgagactctgtctcaaaaaaaaaaaaaaaaaaaaaagtatagcttagcttaaacaagcaactctgcagttggcctatcaccatcagcagtactgtgctaagttctgattggttgattagcttgttgtctgattggtccagttgtcagtcagcgatgtacattgcataagtgcaggttctagcaaccatttttttgcacttaagtaatatttgcattgtccattgtccagtacctaatagcttttgttttaagtaaatatttgacaatgtccaactgaagagattctatacatgaaatgctcaacatataatgtcttctttaaaagcctgatgaaatgtggctttggtatgattctatggcatagtttatataaccagaacttatgtgacaaatgggtaacatattcaccttgtaatgactgagtattttgaaatcttcaattaggtagaaagaagttttattgcaacctagctccaagtctgtggtctggcaaggcccttgcatatgtgaggtccagggcactgggccagggcttcttaaccctttatgatccttgctgtcttctgctaaacacgttgtgcacatgtaccctagaatttaaagttatatatatatatatatatatatatatatatatatgtaaatctcatgtgccaaccaaaccccaaatttggaatatggctctctagaagggcatagtctgtcttctgtgatcttcacaagttcagaagcttagtttctatgattttcatgctcaaaagagtagtggttttccccaaatctgacgttattgaaaactgaacatgaacatgaacatgccctttcaaacgaataccttctcccattctaaaacggtcattcttcactttagaagattgctgctgcaaagccaattctgttcctgcctttcttatctctctcctccatttctctatcctccaaacccctagcatcatattaaacatgtatcatgtgctaataaacactacaaaatgtgatctggctgatttaaagtctaacctgaggcttgcaaataactacaagcaagtcatttgacctacttcattaagtctggccaaaaatatggttacatgcttttatttcttcagttaattgtttgagttaccccttctctatcaggaaatcatgtatccccttttcgaggtttttccatccctatagtctaaaaatcctgagggtttcctcagctcacagggagccaaaaaggtaactgagtttgagggatctaccactgctgttgcttcttgctgtcacttggtgtcaccttgaagactggttcagtgaagataatatctacctcacagaggtgttgtacaaattaaatgagcaaatacatttaaagtgcttagtatatcgatggatacatggcactaagtaggtactcaaagatttagctattaccttatgttatcaggccttagttttatgtagggtctacaccagaggatccctggaagcatctcagctttggcaaatggtgaagttagttcagttcctgcccctcccagaagcctctatcttactcacattgtcctgaagttgatctgcctctagtatatggaagagacagaacctaaggagcatagaattttttataaagcaaatgatttgttctggctcagagaaggagtttttttttaattgtaatctggtgtgtttggactgaaaaaacattgtctcaggtcaccgggctggttggtagtagctgggccttaaccaaagtcttcctgaatgcagagcttgatcaactcaagaagtaccctgctgtgctttagaaagcaatgttctggacagcaaggctgtggctcatttattttttcattctccccattctgagcacattgctttatacataacaagaaatagctcttctccatatcaactgctgttaaagatagtcacctgtgcacacatgcaaacacaaacacattcgcacatttaggaattctctctgccttccatctctttgtttctccttctttcctacttctaggccataataattaagaacaaaatgcacggtgcatataaaccttttcttcccctttgagtaactattgttgctttacaacgttccctatctctgttttaattaccagatttcacaccatcaagaacacaccattcttggaaaatggcaacaccttatctcctctttaataaactttgtgagtagcacatacaagatctccaaatagtaatttattttaggtcatgtgaaaaaggttcattgcccacatatattaaaaggtaatgaatcattaatgtaagctaatcccacttgccaatccatttatccatttgggttgtgtgctaaaagtccattcataagtcaatttgcagccaggtgtggtggttcatacctgtagtcccagctacttgggaggctgaggcaggagaattacttgaacccaggagacggatgtggcagtgaggtgagatcgcaccactgcactccaacctgggagaaagagtgagactccatctcaaaataaataaataaataaaaaataaataaaaatgagtcaatttgcttgtttctgtgggtaactatattatctattattatatcatattatatataatagtgaataataatagcagtaataatagctacagtttattaagtaccaggtatgttacacatattatctctgcttttcacaacagccttgcaaaatgaatagcccattttatagatgaaactgaggttcaaataagttaaggaacttgcttttaagcacacaaagtcaaaaatatttcctgcctcaagtatagctcctcctgaagtggtagtggtgggtcactcatgactttcctcaccacatctgttgggccccagggtgggcgcctgaccgaacgccagccaatcctggttaaggcctgatttgaaaagatgaacttggccaatcagattctcccttaggaatttgaattgggaaacatggaaagagtcaataagttggtaggagtctagggctgaaaggcacaatggaaagttgttaaatgagtgttgtgaagagaggctgaggaggccatgatgggccggcctattagagctgaagctgtggggcagtggaaagcaagcagcggctttaatgcagtggaaggaaatggagtcagtgggggtgggacagaaaggatcatgtgcagagagcagccaagttggtgcagagcaccttctctggggccacattctgcccctttcctgcttttccacagtttcagttccagggtagtcttaaaagaaatcctccatcctttgagctaatgttagtgagtgtctgttagtgagtgtcagttcctttcaaccagaagagccaaattaaagtacatggctagtaagtgctggagaggggatctgaacccggggtttgtggatacagagtttttgttcttgtcactgcacccctttgctacattacaaatgccactgtggtctaccacagcctatgaggtcgccataatgtatctgaaaaagaacgaatagtgaacccaagtttcctgaatccttgtcccaagtcttggtttgcttccagagccctggaggagaaggtgagggctaagaaaatctcagataactgggaggcctccagacaacattgagcttctagggtggaagggactgcaatggggagaggggatggggacaggggagggatcggttctcgtcagtgcagagaatgggggctccccaagggcagggattattggtcttatccctacttctatccccagattccaagatagtgcctgccacttatttgaatgagtgagtgaatggataaataaatggcagaagtgagtcatagcccctgtccaaatgtatggatcattcttcagtctagtgtccccaggttaaggaacacatcttaacctgtctccatctctaagaaacaattgatacagcacagtgaataatgtttaccatgactgatccactttagctttaaaaatcacaaagatgatgtagtggtgactgcaatcacggcacagttcaaagactacaaatggacaactctggattgcatttgccttgtttacaaaaacaccgcttgctttgtctggagagagtgaggttttcattttaagaggctgactaaaaaatgcagggccactttctgggcaggcttccaagtgactacatctttctcacagcgttccccagagccccagcccaagctgcctggggcagggcctctagccgctagtcgctgttgaagctaccacaggagaagtcatctgcagcctgcccaaattgctgtgcttttaagccttcccaaggcacagataacagctttggcctttgcattgaaagagacatcagagtttgtcattggccaagctggtgtgtgtgaaatataggagatggcgtgccacgcttctgagtatggcactctttccagccaagtctcctgggtgtgggtgagtctaaatgtttgaagactgccctcggttgtgaaatgttcgaagctgggcattgtgactttccaagggcatgacttggcgtatttcttaactctaatgagcctcagtttcctttttgtgaaatagggatagtattatcctatgctctagaaggatagaagtatctattcatcacggggtgctgcgaagcctaaaagagataacagcagagtatctcatctagtacctggcatactatagacactgaagagcttttgttatttctgaagcatcagtaaaaaacaaaccaaaaggtttcagtgatgatgccctatttttatgtctaacagtacagtatttctctgagactcagtggatatatttgacttcttaatcatacctgtgtagccaacaggaataaaacttcagaggaagttagtgccaaaggaaagtttgtcagactgtattccctttctttttctcccttctagaccctgactgcacctgccccatttgctgatgaaaccaactgccagtgtcaagcaccccatgaaaaactgaccattgctcaggcccgcttaggaacaccaggtgaggctgtacttctttgtcttaaatgggccctgtcttgacattttaaagtatcagaaaggggccgggcgtggtggctcatgcctgtgatcccagcactttgggaggctgaggtgggtggatcaccttgaggtcaggagtttgagaccagcctggccaacatggtgaaaccccatctctactaaaaatacaaaattagccaggtgtggtggtgcacgcctgtagtaccagctacttactttgggaggctgaggtgggaggactgcttgaacccgggaggtggagattgcagtgagccgagattgcgccactgcactccagcctgggcaacagagcaagactccatctcaaaaaaaaaaaagtatcagaaaggcccatcattatttgtgcagcacttgctttcaagcagagagttgaacttagagattataacgcagtgcaagggtaaagaagggtaaacactagcagtgataaaccagaccaaccaaaggagccaagaaaaagatgcatcagaatacagggagtttgagccccagctttgtcacttgttagttctacagccttgggcaagtcactagaaagatctgaatctgtttccttaaaacagggataacaatacctacctcacaaggtttctgtgataactagattcatcaaaagtaccaaagcatttttaaaaccatgaaggcatatacaaacctaagctactataattattgccattcttaaaagtatgcattttttaaaaaaagtttctagtgtgccttaaaaagagtgggttgtgctatagaagtttgttcattcattcatccctttagcattatgccagaggatggatagggaagagatttggaaagaattataaggtaccatctgtttttcaagagacaagacaactagatgtgaaataaaaaacattagtagcatgtgtgcaggtgcttaggggttaaaacctgcaacacagatgataactgattcttagagaatggcagattcatttggcctgagtgatcatgcaagacttccgggagggagcagaacagacattttaggagaactaagatttggactgtgtgggcagaagatgcaaaggtattgcagacaggtggaagaggaatagtgaagacagaaatagacagctgtgtaggagtgagtgttgttttagttgattgggatggggtgaaaaataagactagttgaacaggtaaactttaagccatttaacatggcataactcggccgggcgcggtggctcatgcctgtaatcccagcactttgggaggctgaggcaggcaaatcacttgaggtcaggagttccagaccagcctggccaacatggtgaaatcccgtctctactaaaaatacaaaaattagccaggcgtggtggcaggcacctgtaatcccagctactcgggaggctgaggtgagagaatcatttgaatccagaaggtggaggttgcagtgagccgagatcacaccattgcactccagcctgggtgacagagtgagtctctgtctcaaaaaaaaaaaaataataataatataaaataaaataacatggcataactctatggtttctagttgccattgcagaaaacaaacaaaaaaaaaaacaaacaaaccaaacttaagagaatccatggaatgaagaacagtttgcttaacaataataatggatacttattaagtacttactatgtattaagatctttatatgtatcatgtcatttcactatcacaactctatgtgattagtagttttagtatttcacagatgaggaaatgaaggtttagagaagttgtgaatctgcacaaggtcattcactactaagtggcagtggttcacactggagcctgcattagaatctactagagggcttcttaaaacccagatggctgggttccactcctagagtttctgattcagtccaactggggtggggcccaagaagttacatctctaacaagtttccaggtgatgctactgctccagggatcacactgggagaaccattggtaagtggtaaagttgggatttggtctcaaacctattggtcttagagcttgacctctcaaccatgacactgtgcttcctataagaatagccttcaatagagtgaagtgaggagcagagtaggcagagttaggaagctttcgtgtgagctgcttttgaaaaaggcaaaacaaggttggggaggtagcacagagcagccaaagctgttgttcccaggctttagtgtacaaagaatcacctggtatgcttgttaaacaagcagatttcctgtttcattcccttcttcccaaatctgggatggggcccaggcaagccatctgcattttaaacagatagtcagggtgattctaaagttagtggtctggagaccacacacagaaataccaacccagcaatatatccaagggatgccaaataaaagtccaggtggctgaccgggcgtggtggctcatgcctgtaatcccagcactttgggaggctgaggcgggcagatcacctgaggtcaggagttagagaccagcctggccaacatggtgaaaccttgtctctactaaaaatacaaaaaattagccaggcgtggtggcgcatgcctgtaatcccagctactcaggaggctgaggcaggagaaacgcttgaacccaggaggcagaggttgcagtgagccgagatcgcaccactgcactccagcctaggcgacagcgcaagactctgtttttttaaaaaaaaaaaaaaaaaaaaaaaagtccaggtggttatgaagaaaacagacttgacctaaagttaaagggtgagcatcaggcccaaactgaaagggcctctacctttctagggaaaggaaagggaagtagaacttactatatatctgtatatatctgctcgatgtgatgctctgtactctttgcaaagaccatgtgagatgactattattgtatcctttctaaagaggagacaaaggagacttgcagaactgaaaagtaacttgtcaagtgtcctagttgactgggtagagctggaatttgaccccaagtccattttgcctcaaacccctgctttgcctactgcaacgatctgccttatgaatcatggtccacagcaggccatggagctaagtgaaaacatgctcagacagtagctgtgatcttctgtagtggcaggactatgccatgctcactgctgtttcatcagcatctagagaaatacttgttgcatacgctgcggtcaataaatattttgtgagtgaatgaatgaaagtttggaggcaggcgggtcacctgaagtcaggagtttgagaccaccttggccaacatgatgaaaccctgtttctactaaaagtacaaaattagccaggtgtggtggtgcatgtctgtagtcccagctacttgggaggctgaggcaggagaatttcttgaacctgggaggcagaggttgcagtgagctgagatcgagccgctgcactccagcctgggcgacaagaatgaaacttcacctcaaaaaaaaaaaaagtgtgggacaagagaagtagttcttcctctggaaatagaagcagagagagtttgttctggcattttgagctggtatcaagctaactgggtgaaattgggcacctgtacattgcctgctgccaagcagtttaagcagtaataagatggtggtgtattttgaaataatacaggtcattagagggggagtgagatggaacaaagatgaactcctgatctttagaagagaaattctgcccactaacctgaggtgatgaccctgggaaattatctaagaaaatccgtgatgttgatgagtacctagccagggtacttgtgttagaaatttctttatttagaacttcaaatatcaggccgagggcggtggctcatgcctgtaatcccagcactttgggaggccgaggcgagtggatcacttgaggtcaggagttcaagaccagcctggccaacatggtgaaaccctatctctactaaaaatgcaaaaattagccaggcgtggtggcgtgttcccaggtgatgctgctgctgctactagtcctgggaccacactttgagaaccacagcataagagcaactgtcggcagtggttagaaggagtggtagggagattatccaatatcataattgttggagcattgtactgttagcagaaaagctcggagaatttttaagaatcttgctgtttgattaccatttaagaaaacaagaaaaacgttacttttttgaagggtttgttcaagagtttcaagaagggtttggtcaagaagggtttggtttcaagagtttcaagaagggtttggtttcaagggtagtaagcaatttacctgtttgtggcactgtcttgagcgtgccctcaaaaaagacaaaacatagcagaatttggtatttgataatgctcttcaagattatagttttttgtttgtttttcttttgtatttttagtggagctggtttcgccatgttggccaggctggtcttgaactcctggactcaagtgatctgcccatctcagcctccctaagtattgggattacaggcatgagccactgtgcctggcctagattatagctataactggactctcttaccatctcctacactagccatattttatgacataatataattgcctaaaatgtgttttacaaatttagaactgcccaaacaggggctgggggtacaaattctagaagaggtaatgacaaactctgcccatagctcttagctttttgaccttgtttgtgaggtcacaagggtgatgaaacttcaagagaaagaacagaataaatcaaaaaagcaatcagaatcggcacctttggtcttagctagtccagctgtggagctgtgcacatacacagtgttgtatgtattctgatgcatggagaataaatcctgtcttgacataaaggaaaagtccaggagattgtttcataggttccttttcattaaaactgcctttcttttctctctttctttctttctctctttctttcttttttttttttttttttttttttttttgacaggttgttgctctgtcacccaggctggagtgcagtgttgcaatcacagctcactgcagtcttaacctcccaggcccaagcaatcctcccaattcagcctcccaagtagcttggaccacaggcatgtgccaccatgcctggctattttttgtattttttgtagagatggggtttcactatgctgcccaggctggtctcaaactcctgggctcgagccatctatccaccttagcttcccaaagtgctgggattacaggcatgagccactgtacccggccctaaactgacttttcttaaagggaatctcggttctgattttctactttccttttcaaaaaggaagtttgtattatctgtttccacagtgtgtagaatttccctgactacatttttcaagagccgccttaatgaatctgccttattcatgtatcatctgtgatgtaatttacttaataatttttctttacatatactcactgttctaaaactttaatgtattttaaaaagcaaacatcaatcactatcatttacagaaaatagtatcattagctagtagcaatggctaatgataagcagaaggtaactacaaagtttatataaaactacataaattatataaaataaatatgtaactataagattttaaaagcttaacttgtgccactttttttgcacatcagttatacaaaaaacagtactagttgccataattactgggtgtttaataatagtttctgttttgttttaaagacaagaattcatatcagcatgtagttttctagcaggtaccaacaaggtagaagaaagagtggtgagtttgatttgcactcaaacatcatcgtaaattggttgtatgacattgggtaagatgcttaacttcactgagcctccatttgcccatccatgaaatgataagtctactttcacctggctccctcatagggttgatgcaaagattaagtgaaatacatgtgttttgtgaattgtgtgtatttctaaggtactgtttaaatgccttaaaatagccacaatccaagccttgttaatagccataatcaaagatgatcaatcactattttattgttgcttgaatctgaagcaaataccaaaaaacgcctaacataccccacagtagtgtgaatttaaacgtaacgtggttggtgattacctcctgtttggctgtatggcaggtgtgtgtttaactttttaaacaactgccaaactgctttccaaagcgattgtaccactttaaattcctatctgcagtttatgagcattccagttgctctgcattctcaccatcacttggtatggccaattaaaaaacattttttagccattctagtgtgtatgaagtgttatctcattgtggttttcgtttgtatttccctaatgactaatgttattgaggatcttctcttgtgtttatttgccatccttgtatttattttctttagtgaaatgtctgttcgatatttttgctttatttaactgggtggtgggttgttcatcttactgaggtttgagagttctttatatattctagatacaagtcctatattttgcaaatattttctcccagtctatgactcaccttttcatttttgtaaaaatgtcttttgaagagcaaacgtcatgagtctcacaggctgcatttaaggtgtcaccccaggctcagttctcatctggaggttaactgttgttagatctgcttccaagctcactcaggttgttagcagaatttatttccttgtgactgtaagatcaaggggtgagcttcttaccagttgtcggccagaggccaccctcagctcctagaggccacctgcaggtccttgccatgtggccctctccataggccctttcacaacatggcagcttgcttcttcaaagccaccagtgcagaaagacagtaagtctgctagcaagatggaccctttttgtttctttttgtggttgttgtttttgtttttttttgacaaagtttcattcttgttgcccaggctggaatgcagtggtgtgatctcggctcactgcaacctctgcctcccgggttcaagagattctcctgcctcagcctcccaagtagctgggattataagcgtccgccaccacgccaggctaattttttgtatttttagtagatacggagtttcagcatgttggccaggctggtctcaaacttctgacctcaggtaatccacccacctcggcctcccaaagtcctgggattacaagtgtgagccaccacgcctggccaagatggagtcttataatgtaacataatcatgggaataatgtctaccacctttcccatattctactgattagaagcaagttacaggtcccacacgcacttcaaggggtgggaattacacaaaggcatgggcaccaggaggcagagatcattaggagccaccttaacgtctctccacgatagccatgcaatagttgtactctgacatctttttttgttttcaattggctcctggtcattgccaaacctccagcttcacaggtcagtggtatctcacatagatgctctggaatctcacatagatgctctggagagtccccagatgcctaaaagcatatccagaaaaatctcaaacaaaagattaaaacagatcaacatacaaactaaaaagccatactctgtttttttttaaagctttattatagagtatttcaaacacacacagaagtagaacaatataatgaaccttcctgtgcctgtcactcatacctaacaaccactaacccatggccagtcttgcaccatgcacacctctgtctactctgtcctcttgaatgatttgaaacaaaatcccagacttcctagaattctgtgtatatgtctgaaaaataagagctctggttttattaaacataaccactgtatcatgatcttacctgaaaaaacaataattccttgatatcaccaaatattcagtgttccaatttctaattatcttatgtcatcatttatatatagcttgtttgaacccaataatgtccatactttacagtaggttgatatgtttttaaaatctctttcaatctgcagatccccctttcatttctctttttctttctctctctctcttttttgccttgaagtttatttgttgaagagatgaaagatcagggtccttttttggcagggaggggagtcctggagaatttcccacagtctggaaattgctgacacaccacaatttttaaaagtgagcttattgcaaaatcaactttgtaaatactcttcagatttactaaatggcctttttctcagtaattacgtcttctttctttacttttctttcctccctgcttcctgaattcatttctcttgatcacctctgaatcaataacaaaaagttttacaaaactgccatctgctttcccctggggtttatatcttaaaacaaattttcctcaattgaattcacattgaataagaacattgaaagcaaggctccctcattagacagtttgttatttcaaagcattttctatttactgtgccttatttagaatacagtataatcctatgaaggcaattctgtttgttcaaatttgtgtataattggaaataattgcaattccctatctgacataaagtctctcaactttttttattagagaaatttaatttattagaaacattgtatcatctgaatctattaatgtaacatttctttatgttccaaattaatgaggttgcattgcatcaagaaataatcacaattttaaatctaagtcttaaagatcatttaacagaagttggcattgatttcttttttaaatttatttttataacatcaatgtaatacatgcatatatatatatatataatttgagacacggtctatctctgccacccaggctggagtgcagtggcgcaatcagctcattgcagcctctgcctcctgagttcaagtgattctactgcctcagcctcccgagtagctagtattgcaggcgcctaccaccatatctggctaatttttgtatttttagtagaaacagggtttcaccatgttggccaggctggtctggagctcctgacctcaagtgatccacccctgcctcagcctcccaaagtgcatggattacaggcttgagccaccacgcccgactatttttaaaagtcagtagtactcccagcttataaagaaaactagcggtccctttctccaccttcttcacccctgattcttattccctgtaggcactcaacacttgacagtcaactttccataatgttgttgacatctctcatccattgtcattgcctttcttgttttctctgcccttgggaggattatatctttttaacttaacttttaactttaacttttaactcttaactctgtaacttttaactcttagtaattgttgtggtgtttctgggagaaagtagagataatgtgtatgttcagttcaccatatttaactgatggtctttgtatttccttttaaagaacattattagctcacgcctgtaatcccagcactttgagaggctgaggtgggcagatcacaaggtcaggagtttaagaccagcctggccaccatggtgaaaccctgtctctactaaaaatacaaaaattagctggatgtggtgctgagtgcctgtaatcccagctacttgggaggctgaggcaggagaattgcttgaacccgggaggtggaggttgcagtgagccgagattgcgccactgcactccagcctgggcgacagagcaagactctgtctcaaaaagaaaaaaaaaaagaaaacaaaacaaaaaacactattgtggccacatatgtctctttccttctcactgcaagaataaaatgtctctatgttgtttgtagccgtggagatgaggtgacaagggtgcttagaatgagagcactttgatatgagaaactacttctttctcctgtcatccatttttgaatcttcttggattttcacattctagttcctttgttgagagtctagaaaggtgtcaaggttggcaaaatacatagaattttctatataaatgtaggaggcatcttccagagtatcatgatggggatataacagagctgcaacttccttcctccaaccagttaaaaagaataattttgtgacttgctttgtctaccaaattgatggaagtctatacccaatttctctctctgacttgaaggggatgggtctttggcctggctgagcaatagtgttatcctggtctcctggttcctggaggtgctgtactgaagtgtgtccctcttcctcttggaacagcactttttagagcactagatgccactgtctgtgtgacctcttcacttttgacctttctccctaggaaggactatagtgttggttgttcatcttcagccctgagcaccacttctacatgcaacattacatcctgactctcctccctttgaggcgtatgtccctaatctcttattataccaaagaggttagggagtggccttgcagtggtatgctagtaaaggtttaacagctggtcctctagcgggaaataagccctgatttgtagcatttgccaacttctgtcgtggaagcactctatcgtggctgacttcaggctaccaacgtgacctggagttgggaagaaaggttgtaaggtgagccatgtgaacagattccagtacatcgttgcctttgagaacagggacttggggtcttcattcaggactgccacacccaaggatgaagccatttgccttttccattgagctcctcagttactcctgcctacgtgttccagctgggctgactctgccggctcaggcacctagactccactctgggtcaagagaactcctcagtgctctgtttttgtctcttctgttggctaaaatagtgtgttccctggtttgatcttaagtttgttatgtttttgctctgctttgatgtcttcagaagaacccctttaaaatcaatttcgtgcactgatatgaaactgatggtatgtagagattgtgtcttatccagaaagtttcttacgactgatagaaggtaactgggattcctcattctgcagttctgttaacagtgttttctttctcccacagctgacaggcctgtcagagtatacgccgatggaatatttgacctcttccactcaggtcatgcaagagcccttatgcaagcaaaaacactgtttcccaacagctacttgttggtaggaggtaagaagtgcattttctttttgtctagaaaactcttttattgtatgctttctgaaaagagcccctttcagagttccatcagtaaaaatctcacattgttaatgcttccaattcagcccatactggctcgcttgttcactgcctgaaatttaaaatgatgtttgaaaaaccataggggaagttacatcatgggattgtataaccctgatcctcagagagagatggactgatagtaccaccaagggtaaatgcttcatgttttccattaatgcctttctattagtgtttaaggcttgatccaaattatgttcctaaaattttctagagggataagagaagcaatattattctgatttcaaatctcaaagaactaaagggagttaggatgatgaagaacaaacaaggtcatcgtctatttcttttgtgtgacctgcagcacttaagacaatgttgtgctaacactagtggcttgtaacagccccacttagttgaatttgtagcagtgtgttaaagacatggagatttatataccgaggtaatcttggttcacaacgaagggaccaatttactcgctaagtctatggaaagagaaggatcgttagatgtggactgaaattttcctcctccaggaggcctatttctttttggctaaaagggatagtacctgactaggaagacctgtatttcacttgtgcagcttcaggaaggagcatattcattcagagtaatcagtttttgtggcatataaactaggcaccatcaagtcttacacctctactgggggaaaaaagtactggtaagagactacataactgttttttaaagaattttgttaccttctgcaattaaaaaccactttgtttgtttgtttgtttgtttgagacggaatctcactctgtcgcccaactggagtgcagtggtgcaatcttgactcactgcaacctctgcctcctgggttcaagtgattctcccgcctcagcctcctgcatagctgggattacaggcatgtaccaccacgcccagctaattttttttgtatttttagtagagatggggttttgccgtgttgtccaggctggtcttgaactcctgacctcaggtgatccacccacctcagcctcccaaagtgctggcattacaggcgtgagccactgtgcccagccaaaaaccacttgttggacatttaagaggaactcttctgcaggttttgccaagggtggtgaccacaggaccattgaatggagttctttccagaaggaggaaatggtggaaggcaatggttactgggcaagtcatgcagagggaacccaaaacaggcagagaacccaacccttgcttacttccctttagcctgaaaaccattccttgagagagcactaccacctggagtctggtcctaggctactggggccctggagagacctctgcagtgtttgggctttggtcatttgggtggcctaagtttggaggtggttaggtgtgggtcacagttaacaggaacactagctgtggccctgggttatcacatccaaagtaagataaaaggaaatgtgtagttttcagtacgttcttgtaaattggaggaggcagtcagttaatatcagcagctctctaggtcattaggcaacaatggtttcactgactcactgatttcttcatctgacaactttcttttttttttttttttttttgagatggagtcttgctctgtcacccaggctggagcacaatggcatgatctcggctcactgcaacctccgcctcccaggttcaagtgattctcctgcctcagcctcccaagtagctgggattataggcgcgtgccaccatgccgggctaatttttgtatttttagtagagacggggtttcaccatgttggtcaggctggtcttcaactcctgacctcatgatccacccgcctcagcctcccaaagtgctggattacaggcacatgccaccatgcccggctacttttttgtatttttagtagagacagcatttcaccatgttggccaggtctcgaactcctggcctcaggtgatccacccacctcagcctcccaaagtgttaggattacaggcgtgagccaccgctcccggccccttcatctaacaactctttattgaactcttactatgtgccaggcatttttctgtacactggggatgcagccatgaacaaaacagactgtctatgtcctcagagaacttgcagtctgagggagaggcagtcattgcccactaaacaagtaaatatgtagtagtggtactatgaagaaatataggaaaagagaaaagagtgactgggcggaggaaggagggatgttttaggtataaaggtcagggaagacctctctgaggaggtgacatttgtgcagagacctgaatgaaataaaagcactcaaaagccagaacatccagtcttccttgtgcaggattctcaccagtcaagacaacagtgtgaggcaagcagagaagacatggtgacatgttagttttttgatttgtgtatcttaaggaggctttccataaaagcacagatgattcagtactcagggaaattaatatgggcagaagtttggagccaagaaataaagcagaagagaaggagaaaaatttcaataagaaatcctggactttttagcagctatagcaaagggggccacacagtcattctatcactctcaaactctagaagctgaattgtaccatcaggaagaactagtttttcctgcctgagttctgagataactgtttcagagggtcactgtgtaaggggcattgagtaatccaaagaacgatgtcctctatagtaggtttacacagaatttcagatattcccttaatggctattacatgggttgtggaagtcaagggcatattgaactacttggatgaccatgagactgtatcctttggtaagtgacaaggactggagtacaggaagaaaataaaacaatacagcatcaagctataaagaaatagtatgtagacttctgggaacagtgacagagtaagagtgaaagctgggcatggtggtgcatgcctgtagtgccagctacccaggagactgaggcaagaggatcacctggacccaggagttcaagggtatagtgagctatgatcgtacctctgcatagctattgcattccagcctgcacaacacagtgagacttcatctctaaaacaaacaagaaaaacaccaaccatgggcaacacaaacaataataaataatttcagtgtgttcttttctctgtagatttcttattcttatcatctcatttaaaataatcgaattgtaatactatgaaatatcttctaaccactctgctaataaaattcagtgacatcctggctgggcgcagtggctcacacctgtaatcccagcactttgggaggctgagttgggtgaatcatctgaggtcaggagttcgagaccagcctggccaatgtggtgaaaccctgtctctactaaaaatacaacaaaaaattagcctggcatggtgctgcacgcctgtagtcccagctacttgggaggctgaggcaggaggattgcttgaacctgggaggcggaggttgcagtgagccgagatcatgccactgcactccagtctggaccacagagtgagattctgtctcaaaaaaaaaaaaaattcagtgacatcctgtatttcatatgtctccattaatttaatatttgatcccaagtctgttaaatggaatctctaacctcctgtgtataggcagactgctatgggggcatggtataagagctcaaatcccaagagtggcattgctgtctgggtgtgatttcccaaatggtgaatgcctcttggtaaaattgtaaacaaaacaaagtgcaatcttcctttgatgtacatagtaattgccttcctctaaaattctgtgtctatcataactgttgcagaaatactttgtgattgtatgcaaaacaaaggcagattctagactcaaataattttatttttctaagttttttatttaatcatttttttttttggagatagggtcttgctctgtctcccaggctgaagtgcagtggagcaatcacagctcactgcagcctcaaactcccgggctcaagtgatcctcccatcttagcctcccaagtagctgggactataggcacatgccaccatgcctggctaatttttctgtttttgtttattgtagagatgggatttcactatgttgcccagactggtctcaaactcgggctcaagtgatcctctggcctaggtgtcccaaaatgctgggattacaggcatgagctagcacactcaacctcaaataattttaaatattatgcagggactttcaaaaatcttgcagggatgtgggaaaattctcatgcagagctgccacatgcattgcaagatgactagcttcattggcccctgcccactgaatgctggtagctgcctccaaccattatgacaattaaagatggcccacagatttccaaaatgcttcctagagaatgatgaaatccttgttgaggaccactgtcttagactaggagtcttgaaattttgttccccacaatctctaaaagaattttgaaaaatctgtataccttcttatacagtttaaagcagatgtctaaaatttatatatcaggccgggtgcagtggctcacgcctgtaatcccagcactttttgaggccgaggcaggcagatcacatgaggtcaggagttctaaaccagcctggccaacatggtgaaaccccatctctactaaaaatacaaaaattagctgggtatggtggcaggtgcctgtaatcccagctactcaggaggctgaggcactagagccacttgaacctgggaggtggaggtttcagggagctgagattgtaccactgcaccccagcctgagtgacagagcgagacgccatctcaaataaataaataaataaataaaataagtaaataaaatttagatatctgcttcttaatttaagtagttataaaagatgtaaattctggaatattgtgagtattagcctttttaaaaattaataaactttattttttagagaagttttaggttcacagaaaaattgactggaaagtacagcgaatccttgtatactcctttctcgcacaggcacaacttcccctactatgaatatcctgccccagcctgatgcatttgttacaatccattagcctacattgacacatcattatcacctcaagtccatagtttacattagggttcactcttaacgttataccttctatgggtttggataaaattttacattgtccaaactcatagatgtacattgtataatgacaggtatccacaatgatagtatcatacagatactatttttactgccctaaaaatcctatatgctctacctattcatctcttcctccctgtaacccctgacaaccactgttctttttagtgtagttttactttttctagaacatcatataattagaattatacagcatgtagctttttcagattggcttcttttacttcataatattcaattaatgctcctcaatgtcttttcatggcttgctagctcatttctttttggcgctgaataatgttccattgtctggatgtaccacagtttatccattcatctgccgaaggacatcttagtggcttccgcattttggcaaatatgaataaagttgctataagcatccatgtggaggtttttgtatggacatacattttcagttcatttggataaataccaaggagtgtgattgctagactgcatggtaggaatatgtctagttttgtaagaaactgccaaactgttttccaaagtggctgtaccaggagtgggtatagctcagaggtagagcattcaactgcagatcgaagtggctgtaccattttgcattcccaccagcaataaatgagagatcctattgcgtcatgtccttgccagcatttggttgtatcaatgttttggacttttgtcattctaataggtgtatagtaggttgttttaattttcaatttcctagtgacatatgatattgaacatttttcatgtgcttcctggccatctgtagatcttctttggagaggtacctgttaaggtctgtagcccattttttaaaatccagctgttttttttcttattgttgagttttagagttctttgtatattttgggtagcggtcctttatcagttgtatcattttcaaatatttttcgcccagtccatgtctttttttttttttttttcgagaaagagtttcgctctgttgcccgggctgcagtgcagtggcacgatcttggcttactgcaacctctgcctcccgggttcaagcaattcttgtgcctcagcctcccgagtagctgggattacaggcatgtgccatcacacctggctaattgttgtatttttagtacagacagggtttcaccatgttggccaggctgttcttgaactcctgacctcaggtgatccaccaacctcggcctcccaaagtgctgggactacaggcgtgagccatcgtgcccggcccccagtctatgccttgtttcctcattctcctaacattgtctcttgcagaacagaagtttttaattttaataaagtccaccttatcaattgtttctgtcacggttcatgcctttggtgttgtatctaaaaagtcaccaccatacccagaagaaacccatctgggttttcttctgtagagttttatagtttggcattttacatttacatatagtttggcatttacatttgatttttgtgaaggatgtaaggttatgtctagattaatttttttttttttttgcatgtgaatgtccatttgttccatttgttgaaaggtctatgtttgcttgcctttgctcctttgtcaaagactggctctctgtatatttgtctgggtctatttctgggctttctgtctgttccattgatgtatttgtctgttctttttgccaataccacactgtcttgattactgtagctttatagtaggttttgaagtcagatagtgtcagttttctgacactttcttctccttcaatatcaatttggtttttctggatctttttcctttccatataaacttttatttttatttttatgtattttttaagagacagggttttgctctgtcactctgaggccctacttgagctcctggaggtaaaacccacaaaagtatttgtcccctggcttcttgaactcttagacttgtccacactgaggtgccagcgatttgtcagtttaaattttcctatcccagcactggttcctggggaggtagctctgcttgtgggtttctgctctagtaagctaatattctctctatctgcctgtttctctctccaattttgggagtagtggtttgccctgtgacctcagttctctgatggatctaagaagacctgtagatttgtcagtttgttcagtttttacttgttgtcaggaccgagtggccacttttaagctccttacctaccagactggaaaccagaaatccaatattgacattttaaaacaaaattatgggccaggcgcaatggctcccgcctgtaatcccagcactttgggaggccgaggtgggtggatcacttgaggtcaagagttcgagaccagaccagcctggccaacatgatgaaaccccatctctactaaaaatacaaaaatactagccaggcgtgcacctgtagtcccagctactagggaggctgaggtgggagaatcgcttgaacccaggaagcggaggttgccatgagctgagattgcgccactggactccagcctgggtgacagagtgagactccatctccaacaaataaataaataaatacataaataaaaaacaaaattgttaccccatcactttaatgcatctattggcatctaaatactataatgctttgaaatatatcatcaacaatttacaaaacatataacaagctattttttaacttttaaatatttataagtttcattttttccctcaaacttatattttcattctgcttctctcccataatttttcctaatgtgatgtgttttaatgtttgcaaatcttttagtgatcactgtatcatacttctctgaaacaaaaatatgtatataaattagagcataactaaccaaagcaccacattatatacactttgataaataattgttaacatagacataaatttggacagcaatgtatctcttaatgagatgaatagtatgtacctggagatgtacttatggatgaatataactgactgctagaatgaggcagggtttaacatcaattttatccctattttttccttgtcatagttataagtgctgaaatatgttgttcatgcaaatgtgtagatagaatggaaggagtttgttacagtgatgccactcaattctttgaacttctgagttatttaccaaaaataacaacataatttattattattattgccatcaaaagtaattttaatggtctatcaagtgacaatttgttaagatcctccttcaaatttgttgcaagcaatggattagaaatgacctgacctgcaaaaggatttgttgccaagctattagaatcatttgctttttctctttctgggacttctaacaaaaggctatatcaagagttattaaatgactcttaattatatcccttattcttttacttgaaagcaacttattcaactagatatagccagaaaggatttgggaaatggaaatattagtaatttaattacatcattgccaatcaagtaatttttgataaaatgcttttatcatttgcttacaaccttttttaaaaaacaaaatctcagggctacagtttcagattactaactttgcagaaaacaccatccaaccaaattggcaaaaccagtcctcattgtcaaacctactaaaaacctacaaaccaagaaaatgtcttttcaattcaaatgcattaatgtattttcagttcaaatgtattaatgtatttcaagaagctttataaaaaacactcaaaaataaatgatagaatggattatgtaaaatagaatcagtcaagattaaaatgatgtagatctaatataataagttataaacaagacaagacaataaatcaatgcacttaatttgtagtaatgcaatgtaatttatacataaaattatgtgatatttatacgaagaagagtatgatttttaaaaggcatgttattccttctctaaatattggcacacgtgtgtgtgtgagtgtgtgtgtgtgtgtgtgtgtgtgtatatatatatcaaattctagtgtttgccttttgggaataatcaaataaatatgaaaaacagaaatagttatctttagtagataccatgactaaacttttcctatgtatttaaagatagaaagggggcatatattattaaaaagtaattggtctggaggcagataataattttattttttgttataaagaggtagaaaataaacattatagacaatgagatgaattaggatgacctgtaaatagaataaatattttatgatataagttgataacacaggtttttaacttcctttttaagtaatgcgtatgaagcctgtaaaaaattatgtaaatgttttacccatgtgtctattccaatgtatcttgaaaaatttgataattctagaaaatattctagtcacatttctaagaagcagcagtaccagcctatatagctttggtttattgaagtgattttcaagtaaatagctggaaaaaagtgcttactcttatctacaagagaaaagccatttttaggattcaatatgagtgttaagaatagctgaaaaaatgcttacccttgactacatgaaaaagccatttttttagaattcactatttctttccaatgctccttttgctttgagttcttgggccttatccctaaagatccatgtgttttttgacaatagttgggagaagaggcaaagttgttgggcaaaaatttgcattattctccactctaccatattgagtttctaacactaggcttcacctgtaacagaaatgtgtgtaagacagggaaagacaggaagctttcataggttcatggtgctttgaatggtcactaactgagatttccatttggtttgccctgaaggctaaatcgccctccaccccttccaatgcaacatattaaggtttgggtggtgcctttcttttgtaaagtggagtaagcatggctttggacccagagactttcttgacctagttaatattaggaaagtgtaccactggaagttgaatctggacattgattcgtttaaaactagctgttcatggataccttttgaaaagtctatgtggctgggtgcggtggctcatgcctgtaatcccagcactttgggaggccgagtgggcggatcatgaggtgaggagttcgggaccagcctgaccaacatggtgaaaccccgtctctactaaaaatacaaaaattagccaagcgtggtggcacacgcctgtaatcccagctatttgggaggctgaggcaggagaattgcttgaacccaggaggcggaggttgcagtgagccgagatcacgccactgcactccagcctgggtgacagagcgagactccatctcaaaaaaaaaaaaaagaaaagaaaaaagaaaagtctgtgtgtgtccatgagggtatatgtatcgtagtttaaggagacctttatcttagactgtctttctggagaatgacaaaccaaccaacttaatggcagacaattctatactgaggaaagttagggaggtcttcaagaataggtgtcctgtgttgttggttgaaaggctggatcttgattactgtatgtgtggtcaacatgtaaaatgcttacagtgagttaaatgggcctgccatattaactagggtcccctttccatatgcaggtaggtttgctgtaggagttcccttgggtggagcgaagacttcactcatgaaaccactttggtcagggcaagtatggggacaagtatttggtagaaatacttggtatttgtcagaaatcatttattaaaggaccagaaactgtgataactggaggtactatagtctatttctcaaccttaggcagtaaaaggcaccacaatcgtcatggttttgccctatgattataacaccagcactttttttttttttttttgagatggagtctcactctgttgcccaggctggaatacagtaccatgatcttggttcactgcaagctccacctcctgggttcaagtaatcctcccacctaagcctccccagtaactgagattacaagcatgcaccaccacacctggttaacttttctattttaagtagagacagggtttcaccatgttggccaggatggtctcgaactcctgacctcaagtgatctgcccacctcggcctcccaaagtgctgggattacaggcatgagccaccgcacctggcccaatacctgcacttctaattttttaagcatgtagccagtaataatttgaaaattcttctatgcaagcttaccttgttggcattattttagtgaattgagactctccacttgtaaagctcttttttccttcattttaatttacaagtttgtgtcatttaaaaacaggccaaggaattaaaatttatactagtgtgtttttttccctaaaaaaatttttaaagagtcaccaaatagccacctctgcttcgcaggagggcaataaaaataacaacagtaaacatactactactactatagaagacataaagattactccacaaacttgtgtttattttattatattttaattggaactaaatattctttaagagtcccttttgcctgactggtaggaaattcagtctcagtcttttttttttttttttctttgagacagggtctcactctctcgcccagactgaagtgcagtggtgtgatctcggctcactgcaaactctgcctcccaggctcaagcgattctcctgcctcagcctcctgagtagctggaattacaggcgtgcaccactaacgcccggctaatttttatgtttttagtagagacggggtttcaccatgttggcctggctggtctcgaattcctgacctcaaatgatccacccacctcggtctcccaaagtgctgggattacaggcatgagccactgcgcctggcctagtctcagactttactgggctctctttacctccccagagtcaaacaagtgtccacaatgtttatagaaacaggagcggggcctccagtcttcaacccagggctatttttgcactgccctcactgtctgagcccagataattactagaagggagcagattcattgcacctatcacagttcagtcacctgcagtctgttcccaggtagaactcccatgcctagggcctcacattctcatctctcttgaggtcctgccactggcatctgctgcttgtgggatccatagacatttggccctttccctgcaatttggagagatctcctctctcattgtcttcttctttccagaatacccctcaagttgctctggcttcaggaaaacagcagccaggaaggcaggctgtctactagcaacttgagctcacagcacctacaaaggagtctgtaccacggggccctcatacctgcttggagtagggggcagggaaaagacagaacacaaaatctgaaggaatagatccatgagtgatcgtattttcctactactattcgtaaatggctaacattattcagcattactctctgctcataaagatgatcaaatttaattctcaaaacttcaccatgttttaaagaccagataactgaggctcagagagtttgagtaacttttccggtaatagcagagctgggattagaacccgagtctgttgggctcccaagctcaattcctatgttgtattttctctcctgtgggagcacagtgagctgccagcataggttagttgcagcatgagttcccagatagctcaatgaattcatccatggaataccgctgcccagagctctccatctggttgtcagagtgcatttgccaagactcaagaacaacagtgctgctttgggcgtaattaatgtttagacaataactggtcagcatgttcagctgcttcttgaggtcactcctgggataggaaaataggaccctgtattggcataaacaggatgtttgttttctttgtgctctatcagtaggccattatctcggtcatgtagaagttataccaaattgctcaggtgcagattcagaaagggggaggatgtggcacggcctagttttgtgctgtttaaaatagaaaatggaaaatggatgaatctgaaatccatttctgctcaatatgattctcagggtggtattttaataaggtcctaaaagaacattcaaaaagtcttagattggttttgaaatcatattgcatggcccataaagaattcctgtttatggggtcaaaaactaatatagtcaataaatcaacacatagttattatggccctactacctgtccctcctgcccaccttcccccccacctctgggcataatgggtgatttaaagacaggcagagctcttgactcaagttatttataatatgcttcagggttttcaaatgttgtcttcatcagaatcatctctgaagcttgtcaaagacagagctatctgggccccactacagactcactgaatcaaaaatctcagggagtgagctgggtttctttacatgtgtttaacaagctccttgggtgattctgatactcatcagttttcaggccagacatatggttgatgttgttttggtaatataaacttttataatagaaaacatctcaggaagtatgtataggagatatagaggcatatatatatatatttatatgcatctagaagctcattagtctctcctttgcgtgtatgttgttgaaacgttcctgtaggccaggcgcggtggctcacgcctataatcccagcactttgggaggctgaggcaggtggatcacttgaagtcaggactttgagaccagcctggccaacatggcgaaaccccatctctattaaaaatacaaaaattagccaggtgtggtggcaggtgcctgtaatcccagctactcgggaggctgaggcaggagaattgcttgaacccagaaggtgaaggttgcagtgagctgagatcgcgccattgcactccagcctgggcaacagagggagactctgtgtccaaaacaaaaaaagaaaggaagaaagaaagaaaagaaaagaaaagaaaagaaaagaaaagaaaagaaaagaaaagaaaagaaaagaaaagaaaagaaaagaaagaaagaaaggaaagaaagaaagagagaaagaaagaaagggaaagaaggaaagagagagagagagaaagaaagaaacgaaagaaagaaagaaacaaagaaagaaagaaagaaaagaaaaagaaggaacctgtagataaatataaatctattattgtaaataataataaatatttcttgagtatctatatgtatcaggctttgttaattcattcaacaaatattgttaaaagcctactaggggccaggtatggtacatcagaaaatgaaacaaaagtccctgccctcggggaatttataggggaacaccaacaataaaactaaataagacagctacatgagacaagtgtcatggggagaagtaatgcagcagaggatcacaattcagaagagggtgggtctacttgggaggctgaggcaggagaatcgcttgaacccgggaggcagaggttgcagtgagccaagatcgtgccattgcactccagcctgggcaacaagagcaaaactctgtccaaaaaacacaaacaaaaaaagaagagggtagggggaaagacttgagggagaggagaaggtgagctctatgagtatttggagcacaactattccaggtttggagaatagtgcaaggcccggacctgagaagaagcattcaagaaactgcaaggccggggagctgggatacactaggagactggtcagggaggcaaggagtgggcagaggcgtaggtcttgtcagccactggaggactttggttttactctgaatgagacaggaagggttctgaatttgggaatgacacagactgacaagcttcaacaggctcattctggccaatgagaataggttgttgggagtgggcaaggctggaatcaggagatcagttaagaggctactgcagtcatccctgggagagatgatgaaggggtggggatgggagcagtggaggtgctgagaaaaacatggcttccgggtgtgctttgaaggcagagcctgcagttttcctgatggcttgggtgtggattatgtgaagggactacaaaagaaggttttccaaggatgctgagtgtgactgttggctgtgcttactctgtggccagatttgattctgggtgtgggtcatcattcagttccaagaaaatgatcatatttttgttcttaaaacacatcttgtgagattaggcagtatttgtcttcctgtgtctggcttatttcacttaacaaaataacctccagatccatccatgttgccataaatgacaggatttcattctttttcatagctaaatagtatttctttgtgtttatataccacttatatatggaatctaaagaagctgatctcatggaaacagagagtagaacagtggttaccagaggctggggaaggtagatgacgggggacagggagaagttcatcaacgagtaccaagttacagttaggaggaataagttctggtgttctattgcacattagggtgactatggttaacaatattgtatatttcaaaatagctataagacagaattttgaatgttcttaccacaaagaaatgataaaggtatgaggtgatggatatgctaaatatcctgattagattattatacaatgtatacatgcatggaaacatcaccctctaccccataaatatgttaattattatgcatcaattaaaatttttaaattaaacacatattgtacacttaacattagtgaatttgttggctgggcacagtgcctcatgcctgtaatcccaacactttgggaggctgagaccggtggatcacttgcagtcaggagttcgagaccagcctggccaacatggtgaaaacccatctctactaaaatacaaaaattggctgggtgtcatggcacgcacctgtaatcccagctgctagggaggctgaggcaggagaatcacttgaacctgggaggtggaggttgcagtgagccaagatcacgccactgaactccagcctgggtgacagaacaagattctgtctcaaaaaaaaattagtgaatttattgtaagtacataatattttaaagaaaaaaaaatttcattgcaaagagcagtcagggtagttctgactggccaccgcaaggctctcactgggatcttggtaaacagggactgtacccacaatgatatttcttcctgacacataggagatcttaggaaagctgccttggccaaccaaaagataggatagtgaatagtatttattgttcagtttgtttaaaagcactttttttctaagttctcgaaacatcttttctaaggctgatagtggaagatatccccatttgagggttcaggaacctgagatctagaaaatataagagatgtggaggccgggtgtggtggctcacgcctataatcccagcactttgggagcccgaggtgggtggatcacaaggtcaggagatcgagaccatactggttaacacagtgaaaacccatctctactaaaagtacaaaaaaattagcctgggtggtggcaggagcctgtagtcccagctactcaggaggctgaggcaggagaatggcgtgaacccgggaggcgaagcttgcagtgagctgagatggagccactgcactccagcctgggcgatagagcgagactctgtctcaaaaaaaaaaaaaaaaaaaaagagagatgtgaaaggatgaactctactagatcaaacctttgattttatgactttcttctcttgattgagtgacctgatgtgtagtgactggccctcaatccagggaacagaagtatatgtatttgtgtgtgtgtctgtctgtctgtctcacacttgggttacaaagtacaataatctagtaaaataattggaactgattgttcaaaccattcaaacctcctgtaaatcaggcctcttggttcctctccttctctccctcctgtgtctgttcatttggtcattttatttctgaatggtaattttcactgaggggtgggataggaaaataaaaagatatgaaagtcacattaggtagtgtagagaataattttaatagaagccacagtggagaatgcagatgtaattagcattaaaatgaaattctgaattgtcggtggattttagcttactttgctctccaaatcctttgttccctttaaaaactgagtacaattatgacaagcacctagcgaggctgtgcttcttttgtcctgctgaagaagccttgtctgaaccagggtggctgtgagcaggtcctgggccgagtaatggcatttaatgcatttgcctgttttagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaaggtacttctcattctcccacattctctaagtagcaagattagggagtctggttctgcagccaagactacggaaagcccaaagtctctctcaatttctaaaagaggtaacttcaggaactgtcatgtggaactgcttgatgtggcacctttcgtccgcccaagcccgaggactggtatcctctcacttctttgagtgtgggccctggatctaaaccgcccaggtccaaatcctgcctctatctcttcctagttgtgggaccttgaacaagatatctaaccacactgtactcgcttacctcaactgtaaaatgggatgatgttggtatcttccttgtggacgtgttttgaagatctaagaggtaatcttagttaagcagttagaacactggctggcccatagcaagagctccaaaaatgtcattgtcaccaccatcaccaccgtcattattgatgcttatcgattcacaggcattctttttcatgggacaaatgaacacacatcttatccagaaagtcacaggtcagcctttaaagaaagaactttatatctatgattttgtgaccctgagaatcctactgacataagatttttattagttggaaacatgagagattcttttgatctgcatcaaattatgtgctttgtatctccctaccagccccacattaggagctattctttccttttataagcagtacaaaaaaaataagattaagctgttctaagaattttcttttctatttttaaagccacgatgcagaagagaatagagaacactgataaatgtgcatgagtaatagctgaagagacaatttcccagtgagaataaaaagaaaaaggaaaaactacaatatgatttacttccagtaatcactaccacatttttactaagcatctattgtatattcaacatgtgctaggcattatgggggatacttataatgataatgatggctgtaatttattgagtatttaccatgtgcccggcactgtgctaagggccttgtcattatatgaattgaattcaatctcacagctaccctgagaagttgttattatacattggagaggaaaaggaactaagtttgagtactaagaatagaattaataataataataataataaacatttattgaggatatactccgtactaattgtttttcagcatttttacataattatgtcatttaatccagtgattctcaactggggtgagtttgccctgaggaacatttggcaatgtcttgagacatttggggttgtctcagctagaggggtgctaccggcttctagtgggtaaaagctaagcatgtgccaatgcacaggacaactcccgacaccaaagaattctccagtcccgaatgtcactagtactgagcttgagaaatcctaattgaatctttcccctaacttatgagttatatagccagcaagtagtggggcagggaatcatactactctaaactatctctaaactacctctcaagtatttaactactgctactctaaattacctctcaaggtagagtgaaaccccattataaagggcttgttatacagggctttaaaatctaggcaaggagtgtttgcttgatgttgcaggaaacaggaataaagatgagcaggcatgaggatgaccagaaaaaaacaaaaacaaaaacaaaaaaacctgtttaaggaggataccccatgtgacagcaggatggcttggagaggagggggcctacagtgaggaaggccagatacaagttggtgtcagtaatctgggtgaccaggtcctggatttggtgtagttgcaatggagagaaaatgatgggcacacacctacatatgcatgtgtgcacacaaacacacacacacacacacatcccagcagaacctagggtgagtgaaataagtagagaaaagaggcttattccaaggtttgggtctccccaagacccaaaataaataaaataaaagtgccattggaaggggtcactcgttttcaggaagatgaattaaattcaggacaggacaggacaagatgatttaaagtgacagcaagtggtaaaagagagggatgcagtgggaattaagcccacctggcctggtgccctggcagcccgctaaacatggcctggtgccccagcggcccactccagtctttaagccttgggtaaatctaacaaattttctagtttcagcaccttatgtcccaactgaagtagtaacatgtggcctgcccacctcacaaggtggttatgaggatcgaatgaggaaagagacaaattccttttcacagtataaaatgtgacctaagtgtgagtgcccattgccatcaatgggacaggaaatgaagatttgggttcctcatcataggagggatgataaaaattcaaagaattaatgagttctctcaaggagaaactttagatgcagaaggacagaagaccaagaaatcctactctctggggtaggacaagaaagagggaccagcaaaggagagaaaccaaaacatttattcttctagttcccattatctcatagaaatgaaaatagttggaaatacatttcagccaaggattcaggtctccactataaatgtaacatacaactgccttattttgaaaaggcattatgaagtcaccattccccccttcaaatctgcagacatgcacatccatcccagtggtgacatcactcttctctctcttcaacagattgactttgtggctcatgatgacattccgtattcctctgctggctctgatgatgtttacaagcacataaaggaagcaggtgaggcattcccctgtgctcacctgtcaaccacatcacaataatcaggtgcaataagagacatctgtctgccctgggacatctgcagtgtatacaaacagggagttacaactttaggtgtcccccaggcggcttctacaagccactgttagcatgtgctaaggctcagttatggcacagataccatttaggtatttatataggaatgaacctgagcaccaaagtgctcaacttcaggtctaaggcttaatttccggggtcatcagacgaaaagtgcaggaccccattacttaaatggcagccattttcctcattcataattaagtcttcacaatgagattattggatactcccaagaaatttccttccagaagcaggtagataactggctagttaataatctggactccttctgtccaaagttagtcctgccatatttctagtgtcatcttgtcacatgttagtaatattatcaggtaccatatgtggaggcaaaaaaaaatgggtaaatgttttaatggcttggcttattttctgctattttactatctaccatgcatctcatctataggcactgtaggtacacccatgcataccttcctacatacattaaaccataatctggcaggtgcagatactatagtgagttaccatatgcatagggatttcaagaagtctagtgctccctgcttatactagagccattgttgacatgtgccatcagagccatcttccccactcctggggaccaatgagactccactcagcttgctcccaccatttcccactcagcctgctgccactacagccttttcttggtactcatggaccttcagattcttgaggtaggatgggctcctaagggtcactgacccaggctcctatctccttcttggcatcattgccagctcctggcagaactgatgcttttacattccccatgatggagaactccctgccttgtgaggcagcccgttccatcttggatggttttggctgtcattgtttaatatatgaatcccctgagtgcatctataagccaggaattgtataagagaaaatgaataagacatagacctcacccttgagagagagcagagacagacataaataattacccaaaatataaccagcctgtggcagagtatatacaatacagcaggccagggcagcatgttcgaaggtgggactgtatgaagcacagcgtgtctggagaaaataaacatgttaatgtagtgtagggtgtgtggaggtgggaggcagagatggagactggcaggacaagctggttgaggcttgcttccatatgaagttacatggaaccaaatactgttctgaggcaggggagtgtcgtgatcaggtcttttgtgtgggaaggagcaactggggggccataagtggtttccataactaaacttaactaggaaaccccatttccacagctgacagaaaaaaaaaatacacttgacatgtgaaatcattcagactcttctaggtttgtacttagactgtgtagagtaaactttttgcctttttctcctgaggtgatctaagtttctggagcactctggcctggcatgggatggggatctttagttgtgaggtctcaagacctgcttagccatcagccccacttaccagacccctgtggcagcctctgagactctgtcatctccccactttggcctgagactgtcacctccccactttggcctgtcctggccacagcatctgccgcaggattcccttccctgtgctataggtgtgctgcccagcagtcatgctgatcttaaatcttggcttccttccatattcctctagagagtccccaggaaatttaaaaactgtcctccataatctactagagggcaagggaaaccaggcaatgtcagtaagccatgtcaggccctgtctgacctgcccgccatgttggcctctgtaaaactatttctttccaaaattcctggccataaacaaggtgccagtggccctgcactgagctttctaaaggggtctctttcctgcccctgcccctggtatttgaacctgagtcagagcaagggacagaccgcactcctgttctctcatttctgctgtccgcttcccaatccctctctgcactcctcccctcaactcccagaggtgcttttcttcttcctggagagcagaaaactgccccttaattaatttcatgccttcccagggttaatatacactccagggcttatagtcaaacattctgtaccctgagtctactcagcctctggttcttaatagttcaaaagacacttctgggatttataataccctttttatactcctcaaagcttggctcttcctagtggaattcttgcctttcttaactcttctttttaaatgagccttaaaaagagcctgttttagaagttgaaggctgaacacggcctcctgtactctcagcttcatctgcctccccctgaagtcatcgagttctcagtgtccatgggaacagggcctcaggacagacatgatccctagaaatgaaaacaacattggatactattttgaaaaattattgttacataaaatgtatgtattctccctgatggcatttttgttggttcacactccttgtgggccagcctgggaagctccatgccatcccctgcagggctggtggtggggactgtaccatcctcttaggaaggacttcctgagaagtcaagagcattggataatgggaggcctgacattctcaagtctcaatcttgtttgtgaggagttccaaggaaggaaacctcatacacttcggacttggaagtctgctctggaactggagaagaaactggcagatgcctcagttacatcaagatgggttacagcatggcgtgattaatatttatttatttacttactttacttacttaatttatgagacaagttctcactctttcacccaggctggagtacagtggtatgatcatagctcactgcaacctcgacctcctgggctcaggcgatcctcccacctcagcctctcaagtagctgggactacaggcacacaccaccatgcccagctaattttaaacttttttgtagagtttccctatgttgcccagactggtctcaaactcctgggctcaagtgatcctcccacctcggcctcccaaagtgctgggattatagctatgagccaccatgcctggcctgataaataccctttaaagtcattgtaagatctgaactatgagccagctgctcctttcctaaaattgccataaggatttgttatagaccagtgcttatgaaacttagatatgcctcagatcatctgtggaatcttgtgaaaattcagattcagattcagtaggtctggtggggccagagattcccatttctagtgagctctcaggttgttagatgctgtaggtccataggcctcacttacagtagcaaagatctggaccaggcattctcatccagctgagttatccccagggtttcttgaatcagtgtttcctgggggcagtagttccttggctaccttatagtgtataggaataagcatttggtggcagttttctttctgggtgagtggctgtcagtgagctaagaatatgttgctttcctgatttggggaataaaatgtcaagttccagttgtttaggtgtaggaacaagtccaacatttttctaactctagcaatccagcatccctattgttgcataagaaagtgactcctaaagttagtgacttaaaagagcctcttgatttcactcatgattttgtggggcaggattttagcagaggcttggctgggtagttcttgcttggggtctctcaaacagttgtaatcagatgttggtgggggctgtggtcatctgaaggctcgactgggctggggctcccaggtggtacacttacgtggctggccttggatgctggctatgatcatggcactcagttgcagttgccactggggcatacaggtggcctcttcatgttgcttgggcttctcacagcatggcagctgaaaggtaatatctagagagaaagcaatcttgacagaagccacaaggcttcttctgacttagtcgtggaagtcacacagagttacttttgccacgttcatttggtacaagcaagtcactgaggccagcccagattccaggggaagggaattgggccatctttaatgcaccacaatgccctttccaaattgaatagtcaggtagcattttacttgccctagtagcacaggctaagactcgatgtaacttttcctatgtgcaaggacccttccttgtgctccatcaaatctgctctgctgattccttagcaggagggagaatcacagtaatgatctatttgggacccaggtagagaaggccagaattcatcatgggagaaagatgctcagaaatggcctcagcatccatatttggctttcatactcaaatcatggcttattttgaaagtcaaaagtctctttaaatgaaaccagagatatcaagggcatgacttaagctttacaacactctgctctgcttgtcagaactatgtgtcaaaatcctctagcaaagctggatgaaaagatggagcttaaattaaatagactgtaaggtccacattactcatcaccattctaatattgcctactactgttgaaagtttccttcattaacatgtgctttgctgcttcttaaaatagctccataaccaaatgccgcaattctgaaaagcatgataaaaaaggttctctgatcatgctcattaccgaatatttttagcagagcaataattaggatttgaaggaagccgggtatctcattatgtcaacagaggacttggcttctttcagagacctacctcccaaccagccaaagcaaatctctccctaagccaaatctactttcagttactcaaacacagagacttcaccttctggcttcaaagaaagggtaagctcatggcatcaatgtcttacatgacttgctaaaatccattagtcactagagaatcgtcttattatttcagcaggaggggtgtgggtaaaatatctgcctgctgaaagatgggatggatttctcaccagaatgttccccactgttcccacaaaggtggggatgtcgtctgagggttcccccacccaccagagcctcctgcacagctgggtcaatttgggtgctatttatgttcgtgtgtttagatggttacatcttctgccttccatttggttttccgtgttagattcttccctcctagaaagtgataaaagaagtgtttggcctagtggcaaaccccaactgtcctctgaccatggaacataagaaactggatgttttgtctctaacatcagcagtgccactctgctactgatactataaatgtgcaaatgacatcaaaagaaagctccaaagagacaccctcattggggctgcaagatggaaacattcagagagaactgggtttggaagggcacttagagatcaatattcatctagtcattcattcaagaaatattcctatggtgcctgtttgtcacccagtgctgagaatgtagaagaggacgagaaaggcatgatcccttccctagtgtagcttatagtcaacaagacagttgttgaacaagttattttataaagatcttgctgtatttggagggaaggggagtggtccatgggaaggaacaacacaccagaagacctagtctgagggttgagatatttgcttgaggaagtgacactaaagctgaagcccagtggatgcccaggagttaaccaggtaaagattgtgtctgtggcagagtgaggggaggggaaccaaccctttcaggacactgaagaaacccagcatggctgggctgaggcagggtcagcctactgcacagctccacagaatacaacagcagtccccccctgcagttgtatagcaggggggccttggtttagggagtgaaagggagagggtctgagataaaattggagagaagcacagggaagagacatgcaagctactgcacagccaagttaaggatttgactctgaatccagagaagagcagaaagccagtggagggttttgagcagacctctgacttgcatttagtaagaatgctctgtagaacttgctctctgggttgaggcagacaaaaatgacattgctggagactggttttgaggttcttgctgtgatctttgaccaagatggtgttgaattggtttaggatggatgaaagtgagtgaattagggaaacatttaagaagtagattgggaacttggttggatgtgggaagtgagagagaaagaaatggcacagatgagtcccaggtcatcatgtccaatcacctttttctcagctgaggagactacagttaagtaactcgccttcagagggtttgagtgacttgcccacgtctacaaaccaagaacccagtgcccttgtccccaggctttgtccatactgtcccatgcctgatgcctctgactgagttgccgtaatgatatgggatagaaagatctcagttgccaacaacatgtcatttcagttcacaacagaagtgtaagcataaacctgattcttgcctttgttaatatttgtgacctctttatagctctatatctgttgatatacccacatttatctttgaagactttaaggaagttctattagaacttggcatcctctgtgcttgtttattttttactcagccccacatattctagatgaaagggcctttgagtggtgaaactaccatgtacagtagactgttcttaggaagataaatcatctaaccatccctacaggcatgcctttagatcagagacgacacaaatagtacactttttcttcttttcctttagtataatgtgagcagacttccttggagatgaagcagagttgctgtgatctaattcattgactcagttgttagtcttcatttactttctcactcaatttccatttattgagcaccttccatgtgctagacacaggggctgaggtgggtgctggggatgcaaagacagttaaggcactatcagtgctttcaaaatgttcattttctacatggagacaaatatttaattttttttgtttgtttgagacaaggtcaggctggagtgcagtggcgcagtcactgctcacagcagccttgatcttggactcaagtgatcctctcactttagtctccgaagtagctgggaccacaggcgtgcaccaccacacccagctaacttttgtattttttgtaaagacagggttttgccatgttgcccaggctgatctcgaactcctggactcaaatggtctgcctgcctcggccttcgaaagtactgggattataggcatgagccaccatggctggcccaatatttttgttaatgaaagataagttaggttctgaatgttgtggattctacctgatgacgtcagaaaagacttcccagaggcataaccttgaagctggactttgcaggatgaggaagagctttgcagttaatatgagcagggagggggtatccagggcagaaaggaaaggctcagcatggataaacagcaggggccaggcaagtacatggtatgtcctggaaacaggtctgggatgatgaacatgtagcatttaaggtagagaggaattccacggaactgagggtggaagagtcacttggggccagacgtaaagtcttcattggcatacccaggagctccaactttgtcctgtaaagggggaccattaaaggagatgggtcaactgaggtgatcttaatttttcctctatccgctcttttctacttgaacagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgtaagcatgccacctcaaaccctctgaagaccaccatgccacaccaccaccaccagtgctgctgtttattgagcacttactaagtgctatgcagtgttctccctctctctctctcttttttttttttttgtgtagagatggggtctcactgtgtataatattttaagtttgatttaacttgtttttttttttttgagacagggtctcactatgttgtccagactggtcttgaactcctgggctcaagcgatcctcctgcctcagcctcctgagtagctgggattacaggcatttgccaccatgcctgtgcagtgtccttaacgctttgtatttattttctcatttaacccacacaataacccatgatgtattattatccccattttacagatgacaaaaccagtatctacaggggtaacataaattaaccaaagaacacaggtagtgagcttcacattttataaaggtgcttccttgcttccctcctcttaccccaaactctctctttagagtttttagacttgattgaagggtttctgggagatctgccccttgtaaaaggcaagagttatcttctgctgaaaggaaagggaggagggaagaggcaatgaaagctaaacccagagaaacttttttattctaacgttttaaaattttcatttgattaaggccttacagatgctcattagaaaccttaatggccatttttcattgtccaaagaaattacagctgcttaaataaagcctaaagtctttggcttccttttgtagttctaccatattgttcccacaggactgctgttagtttaataatagagcaactgttaaaacaatatttcagttctggcatacatgtgcagaacatgcaggtttgttacataggtatacacgtgccatggtggtttgctgcacccatcaacccgtcatctacattaggtatttctcctaatgctatccctcccctagccccccaccccctgacaggccctggtgtgtgatgttcccctccctatgtccatgtgttctcattgttcagctcccacttatgagtgagaacacgcggtgtttggttttctgttcctgtgttagtttgctgagaatgatggtttccagcttcatccacgtccctgcaaaggacatgaactcatccttttttatgtatgcatagtattccatggtgtatatgtgccacattttctttatccagtctatcattgatgggcgtttgggttggttccaagtctttgctattgtgaatagtgctgcaacaaacatacatgtgcatgtgtctttatagtagacaaagaacattaacagtgacttagattccctcaggatgccatttttatataataataataataaaaacaatctttaaaataagcaaaacaagctgttaaaaagcaaagagggcagcccagttgctggagatgatgttagtgattctgagcaactgtatttgcctgggctgtgaggtgccgatatctttgattaaaataagaaccctccgtacatacagaattctaacccccaaaatagacgctgtattttcaaaggatgattcatcttcaaagctagatacttaaaattacatgcagctataattatccaatagctcacacaattgatcattggtaccttcaaaataggaggggctcattaattgtgaatcgttgatcatgagttgtcctcacaaggcagggagtgttgagagtctaggctctgtaacttcatataagccgggcaacaaaatgtcaggaaatgtcggaaaatgtcaggtttgagtggcactggaacaagtggctgaacataattcagtcaaagtgattatttagtatctgatagagaataaagccctggttatttcaataaattaaactgtctgttctttcaaattgaattcggtcaaccatccaaacatgtcaagccattttcaaaagttattgctcactctctttaaacggcgtttagataagccacttagctcaaggaaccgtgcaggcagttcggatgcactcactgccttcctgtgacgacaaacctggctgcagttcagagatgaaatctaatgtgttgcatgggcgtgtagacaaatcacggaacctcagaggtgacagggacctgatgccagtcagtcacccagtccaagtccctcaatttagagatgaggaacgctgagcccagaaagggagcctggccaaggtccttcaggtcagggagaggtagaggcagcagcaactccccagtctcatgactcccagcccagtgctcattcagctattctgtgctgccctgagagccatgtatagtaactatttccagtgcagaatgaactgtggaaaagaatgatataaaggcaacagctaacatttgccaagaactcatcatatgctcatctaagtgttttacttggattatctcatttaatcctcatgatgggcctacaagggtgggtaggatgactatgtccaacatagaaatgaggaaacagaggcccagagaggttgaacaactcacctaaggtcacctagtaagtaacggaagacagagtgacctcccatagcacatatatgtatatatatagctctcagtagcaacacacatagctcatgccccagcctgaggctgcaggaaggtttggaaggtcgaaatcaaggactctttacccagttttgcaatattccaggtgtttcaaaaacttccgaaacacaggccaggcacagtggctcatgcatgtaatcccagcactttggaaggccgaggcgagtggatcacttcaggtcaggagttcaagaccagcctggccaacatggtgaaaccccgtccctactaaaaatacaaaaaattagccggatgtggtggtgtgtgcctgttattccagctactcaggaggctgaggcatgagaatcgcttgaacccgggaggcagaggttgcagtgagctgagatcatgccattgcactccagcctgggcaacagagcgagactccatttcaaaaaaataaaattctgaaacacaaaatgaactttagtcccacatagtaaagaaaaatgataagccttacccctttaggagaaacatcatgatttcatgggggaagagccacatgttattttcatggttttaatactgctctcatcaggtaacacagacaaatgcctctgccacttaatactaatgaaacagccaacatacactgagcatttactaaatgctggcctttgtgccaagcactttgcatgcattgtcacagcaaccctaaggtagggatgattattatccccaatttacagatgagaagactgaggtttagaggtgatatgtgacttgcccagcatacgatggtttccaagcacataagtagacattgctgcagaaagactataagaagaacaaaatctgagtctagagaaactatcagcacaaaagctttcatcaccaccaaggaaatcaatacagttaaattagcatagtggaaaatattacagtggaaattttagtataacacataggttctaaggcccagttaatggcccacttatttcaagcaatattgttttaaccatatcccagtaaaacagcgaactcaggcagcttctgaatagtcattgtgtgcacaattcatacttttgtctaagtcccagcagaattgaatggggttatttgcccaatatctatgcacaacaaaagacaactgtgtgttttttattctcctcttatataagtgaatccaactcaaagacatttaaaagaaagaagatattaaaaccacttgtagttccctttacatatccaaatggattaatggcagatgacttttcttacaagagatgtgcctttccatcaacctagcccttgggaaatggcaacatcttgactcttcaggttaggaacaaatacaaattggaataaaatatgaactttaatgtgaatgattgatctctctcatgtcctcttggataaatctgtttttttttttcctgtaaactttcaccaggagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatgggtatgtaatgatttcactttaccccacaatgatgagtgttttcagtttatcctcctttttatggagccactcaagggtgccccttatctcagatccactgcatgccctctactttaggcatcagcctgaatgacttcaagtccatgtcacttccttactgagtttctgctttactcgtcaatatggcacccagtagcacacaaagccacgtctggtttcagtttctagttcttatccagagcttggaagccatctggtgatcacttgagtgtctcttacttcaggagttgatgctgtcgctcatctcagtctcccagttggggatgatgaaactttgggagtacagatgaagtgggctagtggcagcacggagcttgtgttacaagacatggatcatgggatcttggatcaactactggcatttatgttttggggaggagaatccaaagaaatgtactctgtcagtcagtttttcttgtgaggagccctcctcttttactggttgcaagacagagagagaagaagtaggagtttgccctgcatctgtgcccatcgtgccctgattttcccctggtttttcatgacacgcaagtgttgggataaggcacaacagtctttggggactgaggacatgatctgaatcttaaaactgagaggaaatgtagagggtctccttgcctaaaatctgaacaactttgaatgataactatggaaagggaaaagaaaattctggaaacctccactggtactttattggtatttctattgtgcatgcccttcccaagtaaataccagtattatcaggagagttgatgaggggtctgtaaaagagattcgaaaagtttactttagagacgctaaagggttgacgagggttgtatgaaagagatactaaaaacaaaatttcctcctacaacaaaaagaaaaaattccatttgatttctctgattttaagtagcctggatttcctattataatatgagaagtctctaccaaaatccactttgacttaattattttattgacgggttgtcactgctacctctgcttgtttgagctcattcattataggattatctaaaagtgaaacactcaattagtaatagaaaaagaacaatgtttgggaagttgggagagatgctttgcttaacacctggcagcctctaagtgattatagacgtgggtgttataggccaaccatgtcctatcggctgagtctgagaggggtgaaaggtttacaaggactgcatgagccttcaaagactcctagaaagagctggcaagagtggaggagccaagggctgggctccttttcattttccccaggcctgttaaaaatttcagctcagataagttaattcctggtacatttcttaatgtttttgtctatgcatggcactatgcataaagaagaacataaaaacagacaaagtacagaccctgttctctcgtctctatgacatatggtatgaaattttctatttaatctagtgtgtattttaatagttcacattttcacaactaatttccaggctctaaagaaacaactagtggtttttaatgaaaccatgtaggtgttcattcgtttacagggattcagaaacctgtctctgctgataagagttggtatagtaactcaagagggtggatgttttctccacttggagtgagtaaaggcagggaaaaaatgtaatttcccactttgggaggccgaagtggatggattacctgaggtcaggagtttgaggctagcctggccaacatggtgaaaccccgtatctactaaaaatacaaaaaaattagccaggtgtggtggcgcgtatctgtagtcccagctactcaggaggctgaggcaggagaattgcttgagcccaggaggcggaggttgcagtgagcccagatcatgccaccacactccagcctgggtgacagagagagactctgtctcaaaaatatatatatatatgtgtgtgtgtgtgtgtgtgtgtgtgtgtgtatgtgtgtgtatatgtgtgggtatatatgtgtgtgtatatgtgtgtatatctatgtgtgtgtatttctgtgtgtgaatatatgtgtgtgtatatgtatatatgtgtgtatgtgtgtgtatatgtgtgtatatatgtgtgtgtttgtatatatgtgtatatatatgtgtgtgtatgtgtgtatatgtgtgtgtgtgtatatatatatatatatataatttgatgaaaactttatagaccttagtcatttcaggctcccagtgaaggtgaaatagtagctggaattgttcttgggagtctgatgacagcaagccaaggtgatttttaagaaatgaaacccagtttagagactggaggtttttctttttaaaacttgctattagtgtcaaaactgttattaccattaatttaccatatcagccagactaagacattactttttttctgttgacgttaaaaatacaggaatagttacaaggatgttaaacgccaagataagtaatttgcttttcatgaatatgctattattataataattccttatttgtgaatttgggactggaactcatttcttaaaatagaagatctgtattaccggcaaatacagtactgttacaaacaacccaaacttggaaaggcacaaaatagaaggatttaagatacaagttctggtacaatgagataggtatgcagcatagtatgtaacttatagtgggtattccacaaatgtttctgggttaaatgaatgtatgaatgaatggatgtatgaagaagacctattcacagaaccttccagcatctgcaaaggatttgtgtgctaaagcctaaatcccccaccccatatacgtgtgtgtgtgtgtgtgtgtgtgcgcgcgcgtgtgtgtatgtagacagatagatagatgataagcagatagatagccttagccttttattgcttatggtgctaggtacaggactttattacaacttggtgtttggtggatcaaattcagtacacagacgtggtgtgctttgcccttaacaatgttttaaaatttattttagggaaggcatgagctcttgtttgccatagtcacaccttgctccgctgctcctttcccctcccctaacctgactcacacatttatgcagcccatctggccccagggaatatttgaatttgctccttgtggtatagtcttttttaaagcagggtctcactctgttgcccaggctggagtgcagtggcatgatcatgactcactgtaacctcaaatttctgggctcaagcaatcctcccacctcagcctcccagatagatgggactacaggtgtgtgccaccatgcccagctaatttttaaattttttgtagagatacagtcttactctgttgcccagactggagtgaagtggtgtgatcatgactcactgtaacctcgaactcctgggctcaagagaccctcttgccttggcccaccaaggtgctgggattacaggcatgagccactgggattacagtgcctggccatagtcttttaagtctccccaagtgacctcatatttgacattaaggatgccaatataaaattgaagcccttacatgctatctctgagtagaaagtagtgatgatgatgatgatgatgatgatgatagtaaataagaaggtgatgatgatgatattgtctaaaagttgtatggcaggttgaattcttttttcaatgtccttgcacatttattctacccattttatttacttatttatttttatttatttatttatttttgagatggagtctcactcactctgtcaccccaggtggaatgcaatggcgcgatctcggttcactgcaatctctgcctcccgggctcaagtgattctcctgcctcagcctcccgagtagctaggactacaggcatgtgctaccacgcccggctaatttttgtatttttagtagagacggggtttcaccatgttggccaggctggtctcaaactcctgacctcaagtgatccacccaccttggcctcccgccacccattttaatcacacaggaaggtacattttatagataaatatatagatatagacaaaggcctacaaaattatacgatgaaactttcccgtggtctcacaggagttggtaggcggtaggatggagcctggggctagcctctttctcctggtcatgtctgtatccttcaccataggaatgtccacatgatgcagtcattttgcttcattttcctttggtcggggtgtgtcactgtagagaaactgaggtctaccaacatccctctaaggcctttgacaatgccagttgccagaattgtgcttgagaccaggccatctagatttatgataggcactctcagccctccactgtactgctgtctctaggctttctcagcaaacagaaagtgtggtatccatgcctattagttagcttttggtggtaacaaattacctcaaaacttggtggcttaaaacgacaaacatttattatctcacagtctctgagggtcaggaaccaggaagcagcccagctggatggttctgactcggtctttcatgaagttgcagttaagacgtcagctggtggccaggcacagtagttcacgcctgtaatcccagtactttgggaggccgaagcaggtgaatcacctgaggtcaagagttcaagaccagcctggccaacgtggtgaaaccccatctttactaaaaatataaaaattagccaggcatggtggtacacggctgtaatcccagctactcgggaggctgaggcaggagaatcacttgaacccgggaggcggaggttgcaatgactcgagattgcaccactgcactccagcctggggaacaagagtgaaactccgcctcaaaaaacaaatttgtgacaaatatattcatatattcataaacataaaatgtaccattttaaccttttttttttttttttttctgagactgagccttgctcttgtctcccaggctggagtgcgatggtgtgatctcagctcactgcaacctccacctcccaggttcaaccgattctcctgtctcagcctcccgagtagctggaattacaggcgtgcgccaccaccatgcccagctaatttttatatttttagtagaggtggggttttgccatgttggccaggctggtctcgaactcctgacctcaggtgatctgcctgcctcagcctcccgaagtgctgggattacaggcatgagccactgtgcccggcccattttaaccattttaagtgcacaatttagtgggattaaatggttgcattcacattgtcctgcaaccatcaccaccatccatctccagaacttcttcatcatcccaaacagaaactgtaaccattaaacaagagctccctatccccttctgcccccagcccctggcagccagccttctacttcctgcctctataaatttgaccactctatgaacctcatatgagtggaatcatacagcatttgtccttttgtggctggcatatttcacttagcatgatgtcttcagggttcatccatgttgtagcatgtgtcagaattttctttcttttgaaggctgaatgatattccactttatgtgtacatcacatcttttttatccattgttccattgatggatgtttgggttgatgtgaacattggtgtttgagttctgctttcaattcttttgggtatatactgagaaatagaattgctggacaacatggtaattctatgtttaatttttttgaggagccgccttactgttttccatagtggccgcacagttttacatttccacgagcaatgcacagggatctaatttctccacatcctcaccaacacttgttattttctgtttctttgtttttttttttaaataatcgtcctaattttaggcactgctaatttttaagatttttgattttgagaaaagagctacaaaatatagtttgtggatctgcattagatttcccacctgagactttgacagtttaaaaaattttatctttttttaaaaaaagattgttgttgttgttgtttttaagacagagtcttgctctgtcacccaggctggagtgcaatggtgcaatctcggctcactgcaactttgcctcctgggttcaagtgattcttctgcttcagcctcctgagtagctgggactacaggcatatgccaccatgcccgactaatttttgtatttttagtagagatgggattttaccatgttggccaggctggtctcaaactcctgacctgacctcaagtgatccacccacctcggcctcccatagtgctggggttataggcatgagccactgcgcccggccccaaatttttatccttaaacaaaggtacaagtaaaatgtgaataaacatgaaaagtttcttattatgcaactggctaattacaagagaggtggtcatgagcagggggtcactctctgggtaggtgacttaaggcaagttcatttgcctctctgggacttagtcatagcatcagtaaatggggaaagtaagcatagctgccacatagggctgttgcgaggattacattggttcatacttcatttttaaaatctatattttttgagacagggtcttcctttgttgcccaggctagagtgtagtggcacaatcatgggtcactgcaaccttgaactcccaggctcaagcgatcttcccacctaggccctctccccactcaacctgagtacctgggactacaggtgcataccaccatgcccagctaagtttttcaaaattgtttgtagagatgggggtctcacactatgttgcccaggctgatctcgaactcctggactcaagcggtcctcccacttcagcctcccaaagtgttgggattataggcatgagccatcgcacccagactggctcacacttcaacgcccttagagcagtgcctggcacctgtgtcgggcaccgtgtaagggttagttgttattgatttggccagaactgaagcatgggcccttttctctccttgagtttcatcttgcttacccaagggccaaaccaaaccagatcgtaccaggaactttatcatttcttttcggcagataaaccagaatagatctgaaatactgaaacctttaaaggcatttgtcaagacatttattgccccactagatgttaagtacttctggtttttgtttgtttgtttttgtttttttgagatggagtctcgctctgttgcccaggctggagtgcaatggcatgatctcgcctcactgcaacctccgcctcctgggttcaagtgattctcctgcctcagcctcctgagtagctaggattacagacacccgccaccatgcccaggtaatttttgtatttttagtagagacagggtttcaccatgttagccaggttgctctcgaactcttgaactcatgatccgcccgcctcagcctcctaaagtgctggaataacaggcatgagccaccgcacccggccgatgttaagtacttcttaaaagggaaaacttcataggagagaaatagaaaactactttcgtatggacaggactataaatgggattattttcttgagggaaaacattataaatggaaacctcttaatacagtgagagactgaatttaaatacctttactcttggaaaatgccatgcatactcttccttatttgttatatttctaaagtgcttttcttcccaggaagctcattacaaactgtctcctgactgtattgaattccgctcctttgcaagggaaccacccttcaaaatgcaccagaaacagatcagagagctggcaaattgaggctgggagttattttgcatggatattgcattttatgaagtgcgacaccgttgtttatcattaaagattcaagttctttcatcccctcaggcagaatgttctcagctatgagcttgattcaaactatagtagacaagtcgtagatttcttagaaagtgaacttctaatggaaatcctgacaatccattaacagcaggagggctaatggctgccacagaaaatatacttaaagattacagtaataaaaacacatattttaaagtgcctgctagaagttcaagaatgtttttaaatgttgctgttaataatagaccaccaaatccttatagcatttgaatttgcctcataaatgggtttaatctaagggagtgctgttgtactgcaccttttttttctgtttgactttgaggggggcttgatatcttttggcagaattatcaatgccttaatggaaggtaaataattggtatattagcagacgtgtggaattttaaatctggaaaagacctgagcaatcagccatcatctgttattatatctgctagaggaaacttgggactctacaaagtaacgggctagagcttagaaaggaaaaatgagtgttgggggcaggcagtgctattggtgatgcgcctgtggccttaatagttccttaccaatgtcattattgtaacacctgcccttccgcctgatctccttgcatgggttacatgagttctttcttcctactgtgatgcttttttatgataaaagtaatatatattcattatataaccattagaaagtaaagaagggactgaaaatcactcgcagtctcatcatccagagcagtctctctgttagcatttcgggttatcactcccatctgtttcccatctccgtatatgtacattccttctacaaacttgagatcatgcagaacatagtgttctaaaatcattttggctttgcagttgctcatgagtgttttctcacatgatgaaatattatttaagaacctgattctcctcatctgcttattatatcatcttggagttgtacaggtttttctaacctagttagagaatttgcagtgttgtgtgttatacattgcattgaatgtccatcatacacaataaagatttacttacatctctgattatctcctcagaaaatagaagtttttgcatctattgccaaattccccatcagaaaggcattgctgttttatcctcttaccagcagtaacatgaaggtagcccttttcctgagccctcactagctgtaacaaatttttaaaactttagcaatctgatatataaaatgtatcttatttcagccatttgcatttgttcgactactagtgatgctgaacagtttttctagctcatttacaaatttctcttgtgacttgtctatacaggccatatgttcatttttctactaagcttttcaccttcttctttttgatttataagctctgtctatataccgagatctatcatttgtaggtaaactttgcaaaaaattccactattttttgccttttttcttatttcatggtgttttttttttttttgaggtacagaagttttaaaattttgtgtagtcaaatgtcaatgttttcctttatggtttctttctttgcttttatgctgacacccaaaggtatttctaaaacacagatctgatcagactccgcccttgattaaaatctttctgggtttcttgagtaggaaatccagtctccttgtggtgctctaggtccagaccattgccaccccatgggcatttggggttctggccacactaagcaacttagacttagtactccttacttagcatgctctgtttagaaaggccatcctctactagcccccatggacccactccccatctccacccacctcttcctgggcattatcaaagacccagctgagacatgaccacctcttctaccctcttcttcccccccttcctcctgtgtagcacctggtccccagaagatctctgtaacggtttgtaaaatgaataacccaaaggacaagcaaagcctaagatggtaaataggagaattggctttcagggccagttttgtatcaaaggattgaactgagtggctgggggctaaggctcaaatgtgagcaattgaaagaccccaggcagcacaggcaggatgctcaggagttggtgggatgcagcgtctgggaggctgagcagcaggcagcaggcacagtaggctgggagcactgggggcccagtggggagcttcagggaagggctcaattctgaaagcacccagcaaccatcacatgaggtcccaaactggtaaactgatcttaaccaccgaaacctcctcccaccccacagtcttccccaaactgggaaatggcatcactgctttccaatttcttggacccgagactgcagtcacttgattcccgttcctcccacaccccatgtcccatctgtcagtgagtcccgttggctctaccatgaaaacatagccagaccacatactgtaggattctattttgatgacattctagaaaaggcacaactgtagggacagaaaacacatctgttgccagtggctgggggaggggagactccaaagggtcatgagggaatttgggagctgatgggaccctcctatgccttgattgcagtggtggtcactcaactgtatgcattgtcaaaactcacagaactggccgggcgcggtggctcacacctgtaatcccagcactttgggaggccaaagtgggcggatcacgaggtcaggagatcgagaccagcctggctaacacggtgaaaccccgtctctactaaaaatacaaaaaattagccaggccgggtggcgggcgcctgtagtcccagctactggggaggctgaggcaggagaatggcgtgaacccgggaggcggagcttgcagtgaaccgagatcgcgccactgcactccagcaagactctgtcaaaaaaaaacaaaaaacaaaaaaacaaaaaaacaaaacaaaacaaaaacttaacagaactgtacactaaaaagggtgagtttattatacctcagtaaaaatatgggggaaaatatactaggaatcctgccatttttcagcacactgccatcatcccgggccgggccaggctccatcaccatcttggatttttttttttttctcttgagacggagtctcactctgttgcccaggctggagtacagtggcgccatctcggctcactgcaacctccaccttctgggttcaagtggttctcctgcgtcagcctccccagaagcttggattacaggtgcccaccaccctgcccagctaattttttgtattttagtagagaaagggtttcaccatgttggccaggatggtctcgatctcctgacctcaaatgatctgcccgacttggccttcaaaagtgctgggattgcaggcataagccaccgcgcctggccttggattcttattgcaacgggctcataagtgggctccctgttcctgcccccgcctcactgccatctgttcccaacacagcagtcagaatggtcttttgaaaacaagcagcagattgttaatcctttgctcagaattctccagaggtttctcttctcagaggagactgtacgtgaaactgccgcctgatatgtctctggcctgatctcccgcagtgcctccccctctcccttccccaccagctcgctccatactgccacgatggcctcctcctctcctgggacctgttgcatgggtcccctcagactgaaaggcagagttctcacaatggctgccaaggccctccatggcacagccctctgtgccttctctggcaacctcttcccaaccgcctccctcagctcctccccatctatcagccctcaaggcagccgcggtgccctgcctgcgcttcctgggtgtgcgttccatgctcctttcttggggtgctctgtctggagtgcgctgccctctgatttccattcacctggtccctccccttatctcttccaggttcttcactcaagaagcgttttctcagtggggccttccccgagcaccctgtttgcaatcgcagctgccctgctcccagccccacttgctatcctctcgccctctttttctcacagaccacagatccatctgacataccatattttgtttattgtgtgattcctcctcatatctgtgagggtatgaggtcaggggttttgttttctgccacccctccagtccgtaggtcatgactacttgcctggctagtcagagacactcagttaaattttgtagatggaagaaaaaaaaggaagaaggaaagagtgttaagaaccagtggtagctgggcatggtggctcacgcctgtaatcccagcactttaggaggctgaggtgggtggatcacctgaggtcaggagttcaagaccagcctgaccaacatggtgaaaccccgtttctactaaaaatacaaaattagccgggcatggtggcgggcacctgtaatcccagctacttgggaggctgaggcaggagaattgcttgaacctgggaggctgaggttgcagtgagccaagatcatgccactgcactccagcttgggtgacagagcgagactctgtctcaaaaaaaaaaaaaaagagaaaaaaagaaccagtggtgactgtaatcttctgtcactacccctgaatatcactcggttccttactatacatagtcttggacaacacgggatgtggtatgagtgtaggtttgtgggctcaggagttttggggtagtggctctcctgcctgccttacctttttgttttgctgctgcctcagattgcaaagttaacagatgccttctctccaatttatctttagaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaatagaggtggcaaagtgcttctgaaatagtcgagaaaaagacagattccaacctcctcagtccagccactgagacctgatgttggaacgcatcagctccttccagttccatgaatgtggctcatagacaaagccttgctttaggctggttataaaaggtcatctagtgtgaaccttaactttttattcaaaggacagttttgtcaagaactccacgtaaggcctgatgtgctcctggttgtactttctcatcactggtttgacttcattgttttgcagaaattaccttaatccgtgggaactgcaacaaagaaaaacttcctaatatataaaaaagaggagctgctttgctttgcctccaggtttagcggacaagaaatgtctcctgaagcttctccttaaaggatgctattatggaatggcttttcccatttctgaccagttaacagtttcatagacctcaagtaacagtttgaggtatcaaacatagtataccaatagggggtgctacctgcacgtatctgttctatatatgctccaatatgtcatccccgggtgtatcccatgtgcaatatgagtatatagtggtggcattttataatagaccccactcctgcgctccaccataatactcctctgaaatccttggtctcaagaaacatctgttctcttgtgacttgggcactttgtcaagcttattccagattcctgtggaaacgttttatcccaaccaggaaattagtattttgttctcgtggcctcctataacatttttgggtgaaggagaactcaagactttttacagagaactgtgggctcagttatgatctcagcatctgaatggtctaggtagtatcaccattatctctggccctaggtttgccaagtaggatgaagactctaagtgttcctgctgagttgtccaaaggtcctgctccttagtcacctgtgcgaaatgagcagggagagttaaggcatagaaccaaactctttgggttattgtatgggtatgccagtaaattcagacacagagctggggtctgactgaatagaggcccaaaccagcaacttgtaggcagagcccagaatctcttgtgatagaaataccccttttcagaggccttgggaaccagccttctaggtgacaaggggacaaccagtgaaggaaggcggcatgtctttccccttcttgttggggttgaactacctccctatccacttggagatgagtgctgtctgctgtgaagcaaaactatgaggctgagctggcttggaacctctttgttcttggcactttccttctccaggactctgggaagcactcatatgggacagagggctggcaggaacatggcatgtgaagaagaaaacttctttttgcagtcaagggccacccagaatattgctcttcagagagggacaagggcctcattcttccatttggtctctgtcttccatcatgcactcaggtcaagccatgcaagtctgcctaccatttgagttagttggcacttgtagcagtgaaggatgaggccagccaggcaagggaaggtggcgggaacaagggaagagaaaaggaggaaagaagttcctggagggaggaaaggaggataaagaaaatctgctctcataaaaccatttcaggacctcactttacaggtgagactctcttgggaaggcctttgtgcccctgctccatggcccagggcagatagattcacttttacctgaatcttatactctggagcaaatagtgtatcaggctgactatacatttgcaggccttacacgccatactgacaggtgccacttacgtgactcatcagataatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaacttttgatactttttggccatctctcagtctctcccagcccctacccccacaccacctccctgctcccaggcagagaccgggttgcactttgttagggccagcaggtcaactgtaatggccaagagtgagttaaggctggaatgagaaatatgccccaagcttggaggggtaagcaggaataacacaaagcaaggaaagagattctttttgccctagtgaggaaaggaagcttcagaatgagggctggaggatagcaacttaggactgcagaagggggcagcttatgaagatgggagaaagtgggactgaagttgtaggggagcaggagggtagtgattttccgcttttctttctttctttcttttactttctttctctttctttctctctctctctctttctttttctttcttctttctctttttctttcctctttttctttctttctttttctttctctttcttccttctttctttcattcttctttgttctttcttctttctttctttttttttttttttgagatggagttttgctcttgttgctcaggctggagtgcaatggcacaatctcggctcactgcagcctccacctcccaggttcaaggggttcttctgcctcagcctcccaagtagctgggattacaggtgcctgccacgacacccagctaatttttgtatgtttagtagagacggggtttcaccatgttggccaggctggtctcaaattcctgacctcaggtgattctcccgcctcggcctcccaaagtgctgggattatgagcacgagccacggcgtccagccgattttccgctccctttcaagtgttaactcaccccctgacaggtgaagagggaagggttccttttacgcacaaccaaggttagcaaatgcccatgcaggatatggggtccctgcctctctggttgcttcatttcagcacttctatattagctgcttatggggaccctaaaatgaactggtcacccctccaccagctaagaaacaagggtgggattgctgtgccataagtcacactgaacgacttgcttctggcaagcatgctcctgtgtgtcaggaccttaccaaggcaaagaaatgccaggctcaagaggagcaggacgtgagacattggcctggcttctaacctggtctgagtggaagagacacagcttagggatttcagttttgctcttaggctactagatactgttatttcaccccctgagggagggacaggaagagcacggatttattttctctccgtcttcagtacttattttagcatctagtcataccccagggagagatgcgagacggtgtcactggctcagctgaagcagatgagcccgtctctagcagagatgtgcctgtttcttaggcatccgttcagcactagtcttggccatcagatttttaaaaaagaaatagctcatgaggcatttgcaacttctcctctctagacttctttctagttttcctctgttgtgtcactgcgatgtgtccagggacaaagccataagtagagcatacatacttaagactatgctgtacatataagacaagacctgtctgggttaaagcacgaccttatgcccaagcatttactctggtgctgaataacgcgaactactggaatcagcctcccccaactctgcgcgccccctgcccccctgctcctatcccattcttgctctcaaatggaccacaccattctcaactcgtttataaataaagggatgcagaattgc

SEQ ID NO: 4446 - DNA, 84637 bp, human
cctcagaaaccatggaggaaatagagcacacatgcccacagcctcgactggtaagtaaagacaaaggatggaaatgtatgcgtggctatggcataaaagagttccttatgcgcccgcagccagcgaggaaaacgatgcttagaggattttcatgtaaatgagaagagcgctaccgcctaatccttctcagctgtttatacttagcttctataccgggcgctgctctcagtttacaaagcgttattgtattggctgggtaggaaacgggctgcttgggatatgctgtgtttttgtgcttcgggaggaggggagggcctttttccttttaggtgtgttcttgtctgaaggtaaaaaaatcctacagtgcaattttaaaatggtattctctttaccaagctcgggaagagtcccttgttaagttttaaattctagctaaggaatgcttcgttcctcaactgattttggtgcctaatgccaatttggggggaaaaaaatggaaacatggaagcaaaacttccccatccgtttgaaaatgttcaaaataaataaataaataaatacataggagtccctcaatgatttagttagaaataatacgcatttaaaacgaattgtaaaacatttccagagtgtgctgtgagggtttctcttcaggtagtggaaacctggggagctacatttatttagaaaggggttgcatgcctttaagaatgaaagtgtggaaacggggtactgagagcgtccttccgcctccgtaactgcaccgtaactgctctcccaaatttggtcgtctctctatccctggtcatgatcttttaggtagatgtgaaacttcgttcccaaccacctcagcatgtgtcctcaaggaatcaaaaacacgcatgggtggtgggttttctgtggtccgaagtcttgtggaacttggggagacctctctttgagtcccccaatccaaaagacacactagttaaagctatcctttcctttagcgatttccctcaagttaaaaggtggaatattttgattggctgtggagtttgaccctgggaagagttttttaaaaaaggattttgtgatgtagcattttctgtgaacctgcaaaattagggctcgcagatgagaaggccaacccatcataaaactgttatttcttaataagagttaataagggttcaaaggaggcttagaacaacttcctaaaaagcacaaatacagaggaagttatattagagccctgtgggcttttttcccctatgcttctatttttaaaaatgttttctcttagggcagtttaatagtaactgtgccctagcactttagccacttactgaatgacatacacagtgcagtgtctatgttctcatgagatacaaaccatcccaataagtttgttactaagggattcctttgagtcactaaacaacttatggtttagcataaaggaaaatgaccactaaaagcatattacaagattatcatatgcacatatacatatatacacataaatagagagagagactcactctgttttccaggctggcctcaaacttgaactcctggactcaagtgatcctcctgcctcagcctcccaagtagctgggattacaggcttgtgccacagcactggaccaatatatatatgtgtgtatatatatatatgtatatacacacatatatacatatatacacacatatgtatatatatttgtgcccatgcttacccaaaaatatattttttaaagtaaccacaatcttcaaatttgcatcacataccttcctgacagaggtaaagggcagaggagagaaaggcggcatccagctccagtttgtgcatcatttcagtctcttttgcctactatttttccttccatttttacctcttagctattctgcttcttgattgcttctgcctgagggagatgggcagagaaaattaagggaaagaagaaagttcaagttactttcttgtttttttaagatggagtctcactatgtcctccaggctagagtgcagtggcctgatcttggctcaccacaacctccacctcccaggttcaagcgattctcctgcctcagcctcctgagtagctgggattacaggtgggcagcaccatgcctggctaatatttttttgtatttttggtagagacggggttttgccatgttggccaggctggtctcgaactcctgccctcaggtgatccgcccaccttggcctccaaagtattgggattacaggtgtgacccactgcacctggccaagttactttccactttcactcgtgacagcttattccaggtggtaactcacaagaaccacgcaaagctggcaatgtgctctacaccctcacctcccacccattgtagaaataaggaaactgaggttcagagagggtaagtgacttgcccaagggtcacactgctttgaagggggcagagctgggatttgaacccagagctctacaccggaaaagtggaagatctttcttctataacatactcataagtgagatacattcccttcccatctttttggcagttctggtttcgtgtgtgtgtgtgtgtgtgtgtgtgtgtgtgtgtgtgtgtatcatgcacatgcataggtatgatacagatgtacataagttgaactgttgaagcacctgctttgatttacttatgatacaaaattttccacgttgttcatcattgtcatgggctactgaaatttgactctgtttaaacaggggcttgcaaccaatttataaaacactactaaaattttcaaattgccttctctcttattagctaactttgatcactgtagggttatattctaaatttagatttatactttatagcctaactttcctttgctaatgatcttactttaataactaaggcacatgctaactacttaataaaaaagtttgttgatgaagagagtgagcagcaagtgaaaacatgaaattagcatttctttctctggtttttagtagtttctgttgatcttgtagctttgctagtgtcttcatatttcaaattgtataaattctgcatttctcccagcacccaggcatatagctccaaattgtatgtgggtcactgacaccacagccatcaacagagtgtggctactgagttgcttaactaactatggaaagtgtatgaaatatttgcagggggcctgtttaggattgaagctccacacttggattctccttcagagggcaggctccttctcctagttgctgaaatgaagtggggagctggcatacgtgagtgaataaatagactttaaagcagtctatattttagatccctgtaagtaacaaattgataataatattgcagatatgattgaattatatttcaaggggaagttcttctgccaggaaaacttgtagtttctctacctgccttattcttcattagaggaaaatataagaaaggagacgattaaatagaatgcagtaactctgataaagaaattagaaaagaaataacaaaagcattacctaggttttatgatagagcctatattttaggaatataatcttactactcttaccattttaccatggtgctctgatttgagatgcttctgagaactctttacattgttacaatgtttactcttgattcttgacttgttttcagttctttactattttcctgattaaacatgatgcaaggtgactcatcagcttgactgtcaagatgagaaactgagtggccttgggtgatatgatgtaatagcccttcttggaaatctaactcctgagatacaaggactcctctgagcaaggactgtgtcctcatatcttcccagccctcagattatgcctagaaagatcctctgggctcagcaggtgtcccagaagccctttctaacaaggcccagccaccctgaaagttgtctgcttgagaatttggttaatgaccttggacaagttcttctaggggtgcattctgttgtcagaaggaattgtaattctagactgcaatagtcacttccatgaagatggatatactatggatcaactgagaaggccttggaaataaaaaagggttggttcaacatgccacattagcaggaggagttcatttcgggttttacttcaaagtggagcagtgccaagagactgctgtcttgcagaaggtgcattatgtcagtttggaggtagcatgctcatctgctagtattcaaaaagatgaccagatttccagagacatcaatggcttcctttgctaatattgccatctacttagccacccagaacagcatacattttaaaagtgaaacactcttaatgcgcaatattggcgaaaataaacaaacgtgagcttccttgggtatttactgtggtcaactggaattctgcctaaggttattattaggtatcttcctgctggtctctatccaaatgcaacatccatgtcttgcaaattgatactagtcaggtgtatttagcatggaatcaatcaattagtttcttccattcttttaggtttgttctctcactacccctccaacccaatttgcctaatgctaaacccttatggaagaaataaacctaaatcaaatataataggtagcttctgtgttttattttgatgatttagcatatagaaatcaaaagagtgcatgtatatgtcctcaatcaggcagtgaggaagatttaaagtatttagcaatgcagagttttggaagataactgagagaaaactgagtctcttaccaatccttaccaacccctaccatccccttacccatgggatccacagtcagccaggtggttaacaacttccagacacagcaatgcaccaggtgctgtggagagaaataaaagaagtgaatccaaaccccttgcccctaaaggggcatttccgtttaatagaaggtagtagtttggtttgtggaagcatgccaggatgctgaaatcccttaagagagcttttttgtaagtttgactttaacatattagactttcttaaaagctattttttatccattgaggggaagtacttcccagcagggaggactctgttaacccaatccccaagttaagaaaagtccctgcatttgaagaaaaggttttacttgctcaccccaatacatattttgggacatggaaaggatcaatccatttttgagtggatcttaagcccccattgtgggtcacatactggcctagaactctagaacagctctgcccagtagaaatacagcatgagccacatgtgtaattgaaaattttcaagtggccacagttttaaaggttaaaaaaggtgaaattaattttgtatccaaaatattatgtcagcatgcaatataaaaattattaatgagatcttatattattttcttcatactaagtctgaaatccaatgtgtatattgtgcttgcaatacatctcaattcggactagctaatttcaagtgctcagtgactacatgtggctttacagggagcttagacacttgtccagccctgttaggatcagttctgaggacctacaatgataaatacttttcatgttgcacagttcacgtatacatatatgtagtcataactaaaaccaaacatcacttttccttacttcatgttttgcactcttatactttctatgctatcctatcttattctatttcagttaagagactgttgcagtaatctagatgagagttaataagtttgaaattatagaaggacagtgggaaaggagagaactagatggatatgggaaacactaaagagataaatgccccaagatttgataactaagtctgagcatggggcaggttcagtgaaagatcaaggggccaggcgcagtggcttatgcctgtgatcccagcactttgggaggtgaggcaggtggaccacttgaggtcaggagttcaagaccagcctggccaacctggtgaaaacccatctctactaaaaatacaaaaattagccgggtatggtagtgtgctcctgtaatcccagctacttgggaggctgaggcaggagaatcgcttgaacccgggagacggaggttgcagtgagccgagatcatccctctgcactccagcctgagtgacagagcgagactccatctcaaaaaaacaaaaagatcaaggaaggcacagtttgttttctggctccaactagtgagtgccatcactgagatgggtgtgccagggaagtagagtttgtgagagttatgtctgaggtgccatggggacttccacttggaggtgtctagttcatgtttggttggggaactcaggagagagttctgagctggagatatagatctgggagatagcatggaggagatggaagtgaaattgaggcagtgaaatggatgagagtgaaattgagatagtttctggactgagaaggaagtggatggagatggttacctaggaagagtgcctcaggataatcccactacagggctaattctagaaagtaactgaccctgagccatcctatcaggttcttagagggggaaaatagaggagctgtaattaaagctattagactcctccttctattcatctgtctctacatgaaatctggttaagctaatctactttatcccagaatcttcccaggttggaaccctaagaaagactacttaaagggccaatagaagaaggatcatgaaaagaagacagagaagtatttctcaaataactgggagatcaagggaccaagggcagggtaagtttcatggagggaatgtccaatagaatcaaatgcagtagagagatcaaatgagttaaggaggaaaagtttcctttggatttagaaagaagaggtcagtggtgatgtttcagtgaagtggtgggagcggaggctggatggcagtagattgaggagcctataggtggtagggaagtggaagcttgactgagagaggaagcagatagaatgtacagtacccagaggtggacaaatcagggcttagggttactagagactagcttttccccttccttctttcgttcctttcatcttccctcccttcatctttttttccttttatttctcattcctttcatccatccaagatgtcagatcttttggttggctcattcttttaagatgatagcaacttgtgcctaaatataaatgggaaagagccagtgggagagggaaggggcgatggtgatggggacaactgatgaagggaatgtctcttaggctggacaggttgggctccagtgcacaagtggaaggattggcttcagggagaaaaaaagacacctctcccactgtagtggcaaggaagctggcaaggatggtttgggcaagaacaagttataagaggaagggtactgaaagttgaaggcctctctatctgatagcctgtttttcatctgtgaaggtggaagcaaaatcatggtggcttatttctggctagtacggaactataattctggtatatcctgggtagttgagtccagccccaggatatgtcctctcctgaggcctccaggctgtgggtagggagaagtggaaaggctgagatggttcctgatgagatgcagtgatgagagcaaatggatctgcttcgttgtggcctctgggactccacaccaatgcccatcaagccaagtctagatctggccagggagagctgaactagcccacggtgaaaggacagggggctgtcaagacaaatgtgctaaagcttggtctggacttgctggagcccatagtcttgttccagtgtcagttttgccattgaattattgtgtgcacttaagcaaatcactttcctctctggattccattctgtccccgacaatggattggatagatccttagagtgtgattctagctttcattgccttggaacttggtctactgcagtatgttctgtttgagctcatgctcctatcaaaagtctgggctaccccattcctcaccccctgttggttttatccatttggggtaaaaacaggttgcatgatcttatggtaagacacactggctaaatatgaataacaaatgttcacaagcactttgaagttttacattgatgttgtacaaaccacttctgctgtcttctgttttattcttcagatgctttctcagacaggttgaatgtattccaaatcatatatggaatgttctattcattgtttcgggaaacctgtgttgaatctcttcttaatgtgaacagtagcctcctaatttatctatttcatactacagaagtttgaaacattgggccttctttgaggcatggcagtatgggcttgaactatagaggcctttcttaatcaatgttgtccatctaagcttgctacttggggttaaagtccagcaatgggtcaggctgtagtcccaaaactcttacatctttagctggtgccccacacaaagcttctcagtgactgttagggaaataaatgcaggaaaataattatcccatcagatcactggggggaagaatgaaaaggaaaaaaaagcaaggaaggtagaaacaaactaagtcattgcaagctaggcctattttcttccaataatctcccaggtaacagcctctaccttgctaggatctgattacccgttgctggcctcagaccatagcattattgttttaacattcctaccttcctctttatcccagcatgaactgggttgtatgggaggctgggaagctgaccttgcttggggataaagagacagtttagcactcaacaatcttgaaggcagacttgaaaacacagtgattagaaaataaagcagtgagccctggtagtgtgcgcctgtgtaatagtgtgcagggccacacggggctagcctattgagcagaattcattttcatataatctcctccctcccgccaaaatctttgacttggtgtttttgttttctactcggtaattcatgcatgctgaacctgacatcaggatgctgagggttatttaaactgtcatttaagaaaaataacaacggtaataggttaatagaaacatcatgaatgatgtgtacagcctattgccaaccaaatgatgttgaaagcccattcctggtacatgcaggcttctgtgtttcatctctggtgtgcctaatattgactgtaggcacagtcacataataataaattctattgtacctccaaattgtttagttataaggtaattgttctatatgggatgcaaggctagtggtctcactcctttttctccatgggcaagtcggggaattgaacaaccattcacagtgcacactgtattgggcactgtgttgaatgctctatatgtattatctcatttaatcaggctgcagacccatgaaataagcattactattcctcatgttataagtaaggaaataaataatcaagtaatttcccaaagatccaaaaagatacatatgtatatttttgagatgaagtcttgctctgtcacccaggctgggtgcagtggcatgatctcagctcactgcaacctccgcctcccaggttcaagtgattcttctgcctcagcctccccagtagctgggattacaggtgcacgccaccacgctcagctaatttatatatatatatatatatatttttttttttttagtagagatggggtttcaccatgttggccaggatggtcttgaagtcctgacctcaagtgaccctcccgcctcggcctcccaaagtgctaggattacaggcgtgagccaccgtgcccggccccaaagatcaaatattaactgattaagctgggagttgaaattaggtttgtctgacttctaaagcccctatttccatgacacatagttcacaaacttcagtgagcagagaattgcctgctcaagctcccaggtgattcggaagcaagatgtgcctagatgcacttttagagatgctttatttagccctcccagtcatatctgctgtgtttgggaacaggagtagaaataaatcagatatctgtgttctttgtagtaaaactagaaattcaatgtaaatattttgacccagcagttgcattcctaagaaatttgtacacatggccaccaaaaaaactagtattaggatgttcttagcagtgttattcataataaccccaaactggaaactacccaaatgcccagcagaagcagaatggattaaaaaaattgtagtacactcacacaatttaatgctgggtagcagtgagattgaagaatctacaaccacctgcaggaatatggatgaatctcacaaatgtaacattgaatgaaagaagccagatacaaactaatatgcgccacatgatttcatttctataaaatataaaataaaataggcaaagctcatctttgatgttagaaatcggtgtagtggtaggagcatgggatggacgctggaagtgttaggttacgtgatatgtggctgtgtgtacttagcttgtgaaagtccattgagctgcacttaggatatgtgtacttttcttttctttgagacagagtctcactctcacccaggctggagtgcaatcgtgcaatcttggctcactgcaacctccgcctcccagttacaagcggttcttctgcctcagcctcttgagtagctgggattacaggcatgtgccaccacacccagctaatttttgtatttttagtagagaccaggtttcaccatgttggccagcctggtcttgaactcctgacctcaggtgatccacctgcctcggcctcccaaagtgctgggattagaggcatgagccactgttcctggctgatatgtgtacttctctataagtctattattctttagtgcaaagtttaaagatattattattcacaataatgaagaaagggaacactctacattgtatttcccatttccaaataattctggtgatctaataaactctaaggaaaggcatcacatcctacttacaattatagctcttggctgctaacagagcttcaaagtgctcagcccttccaggggccagtatatccagccccaaagagagtctagtgagcacttgaacgaaacaccttatgtctaggaccagtccagccctagtcaggtaatctgtgaattaaaatccgtggcccccaattgtgtactatgcctggcctcacagtcagacaggttgtgggctgaggaaatggatggcattggttaggtagcaagagtacctcagaataaccctgctacagggtgaattctagaaaatagctgacccagagcctttgcatcagggtttgggaaggggaaaaatagaagagctgtaattaaagcttttagaatcctccttttatctgcctattgctacaggaaatctggttaaattaatctactttaccccacagtcttccaggatggaaccctgagtgacaacatttagagatccaatagacaaagagtcaggaaaagaagacagagagtacttctcaaataggtgggagatcagaggtccaagggtaaagcaatcaccttactggtagttacagttttcttgtaaaatatggtttctgttaaagaaatcatccactttgcagaaaatatcatctttggaacatctttcctttagtgactcagaaaaaaagaggttttattattgaaatagaatctagcaaatacctcaagctgagacatgttagaaatatctgtacttctatccaagtatattgcaaacctcccacactgcataatttgttctaatgcttgtttctttcaatcttcaacaatgttttctatatgtcttctaaatatatttgctgacaaaggaatgcattttagtttgacatcagtttttttttctacacattagagcagctagttttactgtagcatgaagaatagatgattttgcaatggtatgagacttttgttttttctctattgagttatggaaactcaaaaaggcttctaaacatttatcgttacatgtaacagtattttgtgacatgctggattgagtatcacatgactcacaacattgaaacattaaacatggaaaaatcatagaggtttatcttcatgttctggatgcttcattttaaaatatgttaattacaataacttcataccatcattagctaatatctcaaggtgatatttaatgttattggtagcagatatttctaatggtcttctgtgagataattttcaattcagctatcttcttgtcagatcagattgggttgtcgtggttggtacctgataatgtggtggctgcagaacttttacagggagtagaagggtcagctctgccattttcttgttgttcacttgtgtttgcattatctttgctttcctatttcattgcaggaaatgtttttgttgttgttgttgttgtttgtttgtttttgagatggagtctcactctgtccccagcctggagtgcggtggcgtgatcttggctcagtacaacctctgcctcccaggtacaagcgattctcttgcctcagcctcccaagtagctgggactacaggcatgcaccatcatgcctggctaatttttgtatttttagtagagacggggtttcaccatgttggtcaggctggtcttgaactcctgacctcgtgatccgcctgcctcagcctctcaaagtgctgggattataggcgtgagccaccgcgcacggcctgcaggaaatgttttaagccacctgctgatttatgtgcattggtttagttaaaactagataatataatccacaaatacctttatctaggctcaggtgaactgcagtatattgcaataagctgaaagcaaatgaaaaaatgtcaggcgatgcaggccacccaactttcacattccctttaggatacctcatgtatttgatgtggacagaaatggggcaccagtgtaaacccatatatcagaattagaaggccaggcgtcatggctcatgcctgtaattccaacacttcgggacactgaggtggaaagatcacttgagcctaggagttccagaccatcctgggcaacatagtaagacactatctctacaaaatttttttttttaattagatgagcatggtggtatgtgcctgtagtcctaggaggctgacgcaagaggatcgcttgtacttaggagttggagggcgcagtgagtggtgatggtgccaccgcacttcaacttgggtgacagagtgagatcctgtctcaaaacaagcaaacaaaaatagatatttttcttggtttttgtaaagctttttttcttattttttgacatgaaaaataaatacagtaagtcctcacataacattatcaagaggttcttgggaactgtaactttaagcaaaatgatgtggaatgaaaccagttttaacataggctaatttatgtaaacaagagttaagttcgtatggcgtatttctggccacaacaacatcaccaaacttctttttaaaattttttattgatatatatactgagacggagtctcgctctgttgcccaggctggagtgcaatggtgtgatctcggctcactgcaacctccatctcctaggttcaagtgattctctcacctcagcctccggagtagctgggattacaggcgcatgtaacgacgcccggctaatttttgtattttttagtagagacggtgttcaccatgttggccaggctggtgtagaactcctgacctcaagtggcctgccctcctcggcctcccaaagtgctgggattacaggtgtgagccaccgtgcctggcctgattacattatatttgtatatacttaatggggtacatgtgaaattttgttacatgcatagaatgtgtaatgatcaagccagggtatttagggtgtccatcaccttgagtatttatcatttctatgtattgagaacatttcaaatcttgttttctagcttttttttttttttttttttttttgagacatagtcttgccctgttgcccaggctggagtgcagtggtatgatcttggctcagtgcaaactccgcctcccaggttcaagtgattctcttgcctcagcctcctgagtagctgggattacaggcacgtgccaccacacccagctcatttttgtatttttagtagagacccggtttcaccatgttggtcaggctggtctcgaactcctgacctcaggtgatccacccaccttggcctcccaaagtgttgggattacaggcgtgagccaccgtgcccggccacttttcaagctattttgaaatatataatacattgttgttaactataatcatcctactctgctatcaaacattagaatttattccttctatctaactgtatgtttgtacccagtaaccaacctctcttcatccctagccccgctcacccacacacacttcccagccactatctcaatgatagtggtatctatcattccactctctacctccatatgatcaacttgtttagctcccacttatgagtgagaacatgcagtatttgtctttctatacctggcttaagtggctctgaaaagagcctttgctttttgaaagtagaagttgttcacttggagctggtgtacttggtgagggccttggtgttgtgagacacagtgtgattggccatctccctaggcagcaggcacaagctgtatggatctccctggaggtgatcgtcgagtacttgtaatgcatcaggaatgatgcacttgaagatattgacaaatgagttcatgatgcccatggccttcgatgagatgccagagttgagatggacctgcttcaataccttgtaaatgtagatagagtagctttccttgtggctatgcttgtgattcttgccatccttctggctcttggtcacaccaccttcttggcacccttctttggagcaggaacagacttggctgattcaggcatgtcaccacaaatcaataactatactgagaaagaagccacttcaacaccaccacacttctaaataaagaccaaaacactgctagtatcattcaacattgaaatacatgtgagctatgtatacatttaagaaagactaataaaaacaagataattatttgccagcttattccagttcagggtaatgggtgactgggacctatcctggcacctcagggcacctggtgggaaccagacctgaacaggacaccatcccatcgcagggcacactcacacacacaacacattcataacactgggacaattttttttttttttgagacagtcttgctctgtcacccaggctggagtgcagtggtgcaatcccggctcactgcaacctccccctcccgagtagctgggattacaggcatgcgccaccgtgcccagctaatttttgtattttagtagagacagggtttcaccatgttggccaggctggcctcaaactcctgacctcaggtgatccgcccgccttggcctcccaaagtgctggaattacaggcgtgagccactgcgcccagcccacattgggacaatttaaagacactaattaacctgctgtgtacatctttgggatgtgggaggaaaccagagtacccagagaaaacccacacagatatgaggagaatgcgaaaatgcttcacggacagtagccctgacctggaaccaaaatattttttttttctcatccacgttataatgaaaggtcatcgaacaaaatgacattattcaaggatctgaggtataaacacaagtgttgctgtctaatggattgtcttgcccatcccacattagaaaacattggtttaggcattctaaatcttaccattggatccaaccatcagggagaaaaaaactgtattttcagggtgcacgttcgtttggccccttaaagaaaatgcttttctgaaccgctttttggtgctggggttctgccttacatggaaggcactatggagacaaacataaaaaaacaggactttctggctaggcgcggtggctcacgcgtgtaatcccagcactttgggaggccgaggcaggcggatcacgaggtcaggagatcaagaccatcctggccaacatggtgaaaccccgtctctactaaaagtacaaaaaattagccgggcatggtggcgggcacctgtaatcccagctactcaggaggctgaggcaggagaatggcgtgaacccaggaggcagagcttgcagtgagctgagatcgcgccactgcactccagcctgggcaacaatgcaagactccgtctcaaaaacaaacaagcaaacaaacaaaaacaggactttctgtactagggggctgttgttgagtgtatcagtaccgatgttactacagtattacccatcataccctttaaggtggcaccacgggaggaatttctctcagaactcagcatcaggaaaatgctgtgctttttcctcaatagctattttgctttgtgcttaaggacaacattaactttgttttcctctttgctgtgactactgggagcttaaagccatttttgtagtcttacctttttgaaatatagaggactgtgatatgcatttctttgggctcatttcacccctgacctttagaaaacaaacatattttgactgggcgtggtggctcacgcctgtaatcccagcactttgggaggccaaggcgggcggatcacgaggtcaggagatcgagaccatcctgggtgacacggtgaaaccccatctctagcaaaaatacaaaaaattagccgggcgtggtggtgggcacctgtggtcccagctactcgggaggctgaggcaggagaatggcgtgaactcagggggtggaggttgcagtgagctgagatcgcgccactgcactccagcctgggtgacagagcgagactctgtctcaaaacaaaacaaacaaacaaacaaaaaacatcaaaaaacatatttctcctcctcaccccagatcttgcaactattattttaaactttcaaattttatttttaaaatcacctcaagttctttggggaaggaggtggaatatgaatatgatataacattgttattgatgttcactataaacttaaattcaattatctaagaaaaaattatttagaatgtggaatttttatatcttggtaaagattgttttctattgttaatagcatctatgcatttaatgagtctaagaggctattcatggtaagttgcacttccatttcaatggtgttacaatgtgaaaaaatggccaacactgattttaagataatatctattgtaagatccctcctactctcagagatgctaaaatgtggggagaaatgtacattttagaatcaatgaaatgtgactttacttatagtactatgagtcttctagctatttgatattcactcactgctgtgaggttggaaagtggccgcatgagatggagtttggtttataagtggtcagtgttttaaggaagcctgtatctccagggcataataaaaattctgatctctgatcaccaaaagggcagtatgtactaagctgacctagatgtgagcattcaggcactggtttactggtttaaaaaatgaacttattatgtgggaactctaaataaagttggaaaatacgtgttgtttttttttttttttttttttttttttttttgagacagggtctcactctttcacccaggctggagtgcagtggcatgcaatcacagcttactgcaggcttgacctccggggaccaagcaatcctcccacctcagcctccagagtagctgggactacaggcgtacaccaccatgcctagctaatttttcatagagagagggtttcgccatgttgcccaggctgctctcgaactcctgaactcaggcgatctgcctgcctctgcctcccaacgagctgggattacaagcgtgagctactgagcccagcctggaaaatgtgtttttaaaagatatttaagataatttttaaactgtgctcttgttttagttttaaccaacttcaagatacttattctcaacaatagaaaaataggcaaaggacagattattctctgaagaaaatacaaatggccaataaacatttgaaaaatgttcaatctttttgtaatcaaaataatgcaaattgaaacagcatgctaccattttttggtctataaaattgacaaaggtaatactcaatgccagtgagatggcagcaagataggtgctttcatacgttgtaatgtgagtataaatgatacagcttttgtaggaggcaatttaccaatacatgttgaaatgttcttcaaatatttatctttaaaatgttcatacccctgatctaagtaattcagtttctaggcatctgttataaggaaataatcagaggttcagaattatgtttagcatgttatttatattagtaaagtataaataatttaatattcaatgatggagaagtatttaaattacggttctttttcagtgaaatgttttacagctatcaaaattagtgaggttgaaaactatttaagtgacatgataagataatcatgatatattgagtgaaaaaaactgtctatccggcaagattccaaacttgttaatatgtatatatgtcataccagaaagcctaaaatgaaatatagaaggagttaactatagttgtctctgggaagtagaaagaattattggtgacttttattttcctctcttaactttcccaaattttctataatatatattatgatgatgataagaaaaagctatgaaagattgacaaatatatttattttattattgagtttaaagtctgtatttgtctttatcaattatcattctcactcctgtgactttaaattcccccattcagcaaatattcttaaggaccttctatatgccaggtactgccctggggaatagggatatagcaatgagtagacagaccaagtccttgctttcttagagcttccctaatagcagggagagacggagcttaaatatacaatgtttcctcatctgatgacctggacctctcttctacctgcatccatgccctgagctgaatgagtgaatctagtctaatggctttatatatcacatactctctcagtttctaaacctgcatctctagcttagtcctttctcccaaacaccagacttatacatccaactgtctacctgacatctccacttggagatctaataggtgtgtcaaaccaaatctgtgagaatggaattgttaatttccccatccttgttgtccctcccacccctagacctactcttccagtgttttacccctcctagggaatggcaatgccatccttccagttcttcaggccagtagctttggaattatcctgattcctctcattctttcacaccctacatccaatctgtttcaagttttatggatccaaaatctatccagaatctgaccacttcttaccacctccgctgcgatcaccctgacccctgcctctgtcttcttttgcctgattattacaccagacacctcagtggttttcttgtttctacctttgacctcttacagtttattctcaacacattagccagatggtcttgttaaagctaagtcagatcattatcatgccttgttcaaaacgctctgatgcccagcactttggaaggctgaagcaggtagatcacctgaggtcaggcgttcgagaccagcatggcgaaaccctgtctctacttaaaatacaaaaattaggcaggtgtggtggcacacgcctgtagtcccagctagttgggaggctgaggcaggagaatctcttgaacccaggaggcggaggttgtagtgagccgagatcgcgccactgcactccaccctgggcaacagagtgagactccctctcaaaaacgaaacaaaacgaaacgctctgatggctcccatctccctagagtgaaagccagtctttacagtgtcctaaaaagctcacacgactgggtgcctctcatctcctttcttctggtctcacctctggctacatcttttcttttttgctcgcttcctccaagcatactggccttctagttattcctggaagaagccaggcatgttcatgcctcatggccttggcccttactgttttctctgccaggaatgctctttctccacatggctcacttgatcctttatatatttacacatacatcaacttctctgactatcctatttacagtgatacccccaacactccctattccctttccttgccttatttttttctataacacttaatcaccctttaactaaaatactacatgttttatgttcttttttgttgcttgtttattatttttaagtgttatgagggcaaaattttttgttttgttttgttccctgttgtatcctcagaagctagaacagtgcctggcacacagcaaggactcaaaaagtgtttgtctgatgttagaaaaatgaattacgggtagataccatgaaagtaatttaaaaattttttaaagctcaaatgagttttaaatattccatatacctgcaaatcatatcatttaacagttaatttctggataatagtttttatttttcaaaatactcctcttttcttaatatagacctccctcccccatccctgctacatttgggagacctgagccttgattaaattttctgcatctctgaatttaaaggagaggagatatttctttaaatttatttttgcattatgaacattgcatgaatgcattctcattttaaaaataaaacaaaatgacagacatatatggaataaacaatgaaatctcttcatctcttctctcaaaatattatctccttcccaagaggtaaccccaattaacaattcaatgtgtatcattcaagtccagtgctgtccagtagaactttctgtgatgatagaaatgttctatatctgcattgcccagtatagtacccagtagtcacatgggttattgagcacctgaaatgtggctaatgtgaatgacaaactacttttaattttatttaattttaattaattataatttgaatttaaatagccccatgtgactaatggctaccatattagcacagttctaaactatttctttttcttttcttttttctgtttttttgagacagagtttcactcttgtcacccaggctggagtgcagtggcgtgatctcagctcactgcaacctccgcctcccaagttcaagcaattctcctgcctcagccttccaagtagctgggattacaggtgtgtgccatcagacccggctaatttttgtatttttagtagaaatagggtttcaccatgttggccaggctggtcttgaactcctgacctcaggcgatccacctgccttggcctcccaaagtgctgggattacaggcatgagccaccgcgcctgtccctaaactatttctacacaattacctctctcttttcttctttttctctctcttcccccttctctctctttttactataaatgacatcatactagatagcatgtatacatacatattatacatattgctttgtgacttgctttttgcattcaacaaaatgtcttagatataattccctgtcagtacatacgtatctgtcttgctgttttcaatggtgcctgttacttataacatgtacattccatacataactaaatgaaaaaaatggatatttcttggtgctgaaccacatactgggcctcttttttcttctctccagtgacatttattggtgatgactttgcaccagctgcctgatttaagagtctacataatcagtgacacagtctaagaatccagtgattcgtgtgtgttgggcccatggttaactatattatctatttttttctgtcctctctatcttcaaaagacaaaatattctgactccacaataaataaggttttaaaaatatgttcagaaacaagtaaatataaacctaacagtatgaggctgctggattagattttgtgatgtctttttgtaattctgaatttgtggttctaaagctgatgagtttcacagcaaaaggcctacctggaagaagtagattctttctgaagtcctgttcttatctttttttgcatatcctgattaaaatgttctgtctttgtaaaattcttttctaccagagacattcttgagatggttataactttagttactctgggtaattcacttttcaattgatttctatgcttctaacatacctcatcagcattttctagctaatgtttgagcctgacaaactgttatagacacggtattaaccaaggctctgtcaagacacagatggctcactctaaaggtgaaattgaaagagagtttaataaaggtaatacttacaaaggtatgggcagggtttaaggaaacctcaaggaatagtatagtatccttggcctagaaacaatgggggattgccatcccccaggctggtaggggcaaggggtgagtgtggttaccagaacctcacacagacagctctataaagaggaccccctcacagaagctgtgaattttggtaaaaggacagaaccaacacactgcttcctagcagagaggaagccagggagacaaataccctgagctcactcttgtcctgacctccactgttttgcacgcttcccaaccaactggaagcaggaggcagagatcccattggtgcagtccattggggaagccatacagaaaagagtagaggaaaagcatagagaagggtagaaagagagtggattctggagaggcaaaagggaagatatttattacccacacattcttttagttaatcctcacaacagcttatcctcctttcataaacaaggatactaaggcttgagaggttaagaaccagcaatttgctaaaaatcaaatgtaaaaataggaaagggatattaaataatggaggtaggatttgaactcaggcctgtctgacgggattgccccactggagttaagaatagcttagcttggccgggcgcggtggctcatgcctgtaatcccagcactttgggaggccaaggcgggcggatcacgaggtcaggagatcaagaccatcctggttaacacagtgaaaccctgtctctactaaaaatacaaaaaattagccgggtgtggtggcgggctcctgtagtcccagctacttgggaggctgaggcaggagaatggcatgaacccgggaagtggagcttgcagtgagcagattgcgccactgcactccagcctgggcgacagagcgagactctgtctcaaaaaaaaaaaaaaaaaaaaaagtatagcttagcttaaacaagcaactctgcagttggcctatcaccatcagcagtactgtgctaagttctgattggttgattagcttgttgtctgattggtccagttgtcagtcagcgatgtacattgcataagtgcaggttctagcaaccatttttttgcacttaagtaatatttgcattgtccattgtccagtacctaatagcttttgttttaagtaaatatttgacaatgtccaactgaagagattctatacatgaaatgctcaacatataatgtcttctttaaaagcctgatgaaatgtggctttggtatgattctatggcatagtttatataaccagaacttatgtgacaaatgggtaacatattcaccttgtaatgactgagtattttgaaatcttcaattaggtagaaagaagttttattgcaacctagctccaagtctgtggtctggcaaggcccttgcatatgtgaggtccagggcactgggccagggcttcttaaccctttatgatccttgctgtcttctgctaaacacgttgtgcacatgtaccctagaatttaaagttatatatatatatatatatatatatatatatatatgtaaatctcatgtgccaaccaaaccccaaatttggaatatggctctctagaagggcatagtctgtcttctgtgatcttcacaagttcagaagcttagtttctatgattttcatgctcaaaagagtagtggttttccccaaatctgacgttattgaaaactgaacatgaacatgaacatgccctttcaaacgaataccttctcccattctaaaacggtcattcttcactttagaagattgctgctgcaaagccaattctgttcctgcctttcttatctctctcctccatttctctatcctccaaacccctagcatcatattaaacatgtatcatgtgctaataaacactacaaaatgtgatctggctgatttaaagtctaacctgaggcttgcaaataactacaagcaagtcatttgacctacttcattaagtctggccaaaaatatggttacatgcttttatttcttcagttaattgtttgagttaccccttctctatcaggaaatcatgtatccccttttcgaggtttttccatccctatagtctaaaaatcctgagggtttcctcagctcacagggagccaaaaaggtaactgagtttgagggatctaccactgctgttgcttcttgctgtcacttggtgtcaccttgaagactggttcagtgaagataatatctacctcacagaggtgttgtacaaattaaatgagcaaatacatttaaagtgcttagtatatcgatggatacatggcactaagtaggtactcaaagatttagctattaccttatgttatcaggccttagttttatgtagggtctacaccagaggatccctggaagcatctcagctttggcaaatggtgaagttagttcagttcctgcccctcccagaagcctctatcttactcacattgtcctgaagttgatctgcctctagtatatggaagagacagaacctaaggagcatagaattttttataaagcaaatgatttgttctggctcagagaaggagtttttttttaattgtaatctggtgtgtttggactgaaaaaacattgtctcaggtcaccgggctggttggtagtagctgggccttaaccaaagtcttcctgaatgcagagcttgatcaactcaagaagtaccctgctgtgctttagaaagcaatgttctggacagcaaggctgtggctcatttattttttcattctccccattctgagcacattgctttatacataacaagaaatagctcttctccatatcaactgctgttaaagatagtcacctgtgcacacatgcaaacacaaacacattcgcacatttaggaattctctctgccttccatctctttgtttctccttctttcctacttctaggccataataattaagaacaaaatgcacggtgcatataaaccttttcttcccctttgagtaactattgttgctttacaacgttccctatctctgttttaattaccagatttcacaccatcaagaacacaccattcttggaaaatggcaacaccttatctcctctttaataaactttgtgagtagcacatacaagatctccaaatagtaatttattttaggtcatgtgaaaaaggttcattgcccacatatattaaaaggtaatgaatcattaatgtaagctaatcccacttgccaatccatttatccatttgggttgtgtgctaaaagtccattcataagtcaatttgcagccaggtgtggtggttcatacctgtagtcccagctacttgggaggctgaggcaggagaattacttgaacccaggagacggatgtggcagtgaggtgagatcgcaccactgcactccaacctgggagaaagagtgagactccatctcaaaataaataaataaataaaaaataaataaaaatgagtcaatttgcttgtttctgtgggtaactatattatctattattatatcatattatatataatagtgaataataatagcagtaataatagctacagtttattaagtaccaggtatgttacacatattatctctgcttttcacaacagccttgcaaaatgaatagcccattttatagatgaaactgaggttcaaataagttaaggaacttgcttttaagcacacaaagtcaaaaatatttcctgcctcaagtatagctcctcctgaagtggtagtggtgggtcactcatgactttcctcaccacatctgttgggccccagggtgggcgcctgaccgaacgccagccaatcctggttaaggcctgatttgaaaagatgaacttggccaatcagattctcccttaggaatttgaattgggaaacatggaaagagtcaataagttggtaggagtctagggctgaaaggcacaatggaaagttgttaaatgagtgttgtgaagagaggctgaggaggccatgatgggccggcctattagagctgaagctgtggggcagtggaaagcaagcagcggctttaatgcagtggaaggaaatggagtcagtgggggtgggacagaaaggatcatgtgcagagagcagccaagttggtgcagagcaccttctctggggccacattctgcccctttcctgcttttccacagtttcagttccagggtagtcttaaaagaaatcctccatcctttgagctaatgttagtgagtgtctgttagtgagtgtcagttcctttcaaccagaagagccaaattaaagtacatggctagtaagtgctggagaggggatctgaacccggggtttgtggatacagagtttttgttcttgtcactgcacccctttgctacattacaaatgccactgtggtctaccacagcctatgaggtcgccataatgtatctgaaaaagaacgaatagtgaacccaagtttcctgaatccttgtcccaagtcttggtttgcttccagagccctggaggagaaggtgagggctaagaaaatctcagataactgggaggcctccagacaacattgagcttctagggtggaagggactgcaatggggagaggggatggggacaggggagggatcggttctcgtcagtgcagagaatgggggctccccaagggcagggattattggtcttatccctacttctatccccagattccaagatagtgcctgccacttatttgaatgagtgagtgaatggataaataaatggcagaagtgagtcatagcccctgtccaaatgtatggatcattcttcagtctagtgtccccaggttaaggaacacatcttaacctgtctccatctctaagaaacaattgatacagcacagtgaataatgtttaccatgactgatccactttagctttaaaaatcacaaagatgatgtagtggtgactgcaatcacggcacagttcaaagactacaaatggacaactctggattgcatttgccttgtttacaaaaacaccgcttgctttgtctggagagagtgaggttttcattttaagaggctgactaaaaaatgcagggccactttctgggcaggcttccaagtgactacatctttctcacagcgttccccagagccccagcccaagctgcctggggcagggcctctagccgctagtcgctgttgaagctaccacaggagaagtcatctgcagcctgcccaaattgctgtgcttttaagccttcccaaggcacagataacagctttggcctttgcattgaaagagacatcagagtttgtcattggccaagctggtgtgtgtgaaatataggagatggcgtgccacgcttctgagtatggcactctttccagccaagtctcctgggtgtgggtgagtctaaatgtttgaagactgccctcggttgtgaaatgttcgaagctgggcattgtgactttccaagggcatgacttggcgtatttcttaactctaatgagcctcagtttcctttttgtgaaatagggatagtattatcctatgctctagaaggatagaagtatctattcatcacggggtgctgcgaagcctaaaagagataacagcagagtatctcatctagtacctggcatactatagacactgaagagcttttgttatttctgaagcatcagtaaaaaacaaaccaaaaggtttcagtgatgatgccctatttttatgtctaacagtacagtatttctctgagactcagtggatatatttgacttcttaatcatacctgtgtagccaacaggaataaaacttcagaggaagttagtgccaaaggaaagtttgtcagactgtattccctttctttttctcccttctagaccctgactgcacctgccccatttgctgatgaaaccaactgccagtgtcaagcaccccatgaaaaactgaccattgctcaggcccgcttaggaacaccaggtgaggctgtacttctttgtcttaaatgggccctgtcttgacattttaaagtatcagaaaggggccgggcgtggtggctcatgcctgtgatcccagcactttgggaggctgaggtgggtggatcaccttgaggtcaggagtttgagaccagcctggccaacatggtgaaaccccatctctactaaaaatacaaaattagccaggtgtggtggtgcacgcctgtagtaccagctacttactttgggaggctgaggtgggaggactgcttgaacccgggaggtggagattgcagtgagccgagattgcgccactgcactccagcctgggcaacagagcaagactccatctcaaaaaaaaaaaagtatcagaaaggcccatcattatttgtgcagcacttgctttcaagcagagagttgaacttagagattataacgcagtgcaagggtaaagaagggtaaacactagcagtgataaaccagaccaaccaaaggagccaagaaaaagatgcatcagaatacagggagtttgagccccagctttgtcacttgttagttctacagccttgggcaagtcactagaaagatctgaatctgtttccttaaaacagggataacaatacctacctcacaaggtttctgtgataactagattcatcaaaagtaccaaagcatttttaaaaccatgaaggcatatacaaacctaagctactataattattgccattcttaaaagtatgcattttttaaaaaaagtttctagtgtgccttaaaaagagtgggttgtgctatagaagtttgttcattcattcatccctttagcattatgccagaggatggatagggaagagatttggaaagaattataaggtaccatctgtttttcaagagacaagacaactagatgtgaaataaaaaacattagtagcatgtgtgcaggtgcttaggggttaaaacctgcaacacagatgataactgattcttagagaatggcagattcatttggcctgagtgatcatgcaagacttccgggagggagcagaacagacattttaggagaactaagatttggactgtgtgggcagaagatgcaaaggtattgcagacaggtggaagaggaatagtgaagacagaaatagacagctgtgtaggagtgagtgttgttttagttgattgggatggggtgaaaaataagactagttgaacaggtaaactttaagccatttaacatggcataactcggccgggcgcggtggctcatgcctgtaatcccagcactttgggaggctgaggcaggcaaatcacttgaggtcaggagttccagaccagcctggccaacatggtgaaatcccgtctctactaaaaatacaaaaattagccaggcgtggtggcaggcacctgtaatcccagctactcgggaggctgaggtgagagaatcatttgaatccagaaggtggaggttgcagtgagccgagatcacaccattgcactccagcctgggtgacagagtgagtctctgtctcaaaaaaaaaaaaataataataatataaaataaaataacatggcataactctatggtttctagttgccattgcagaaaacaaacaaaaaaaaaaacaaacaaaccaaacttaagagaatccatggaatgaagaacagtttgcttaacaataataatggatacttattaagtacttactatgtattaagatctttatatgtatcatgtcatttcactatcacaactctatgtgattagtagttttagtatttcacagatgaggaaatgaaggtttagagaagttgtgaatctgcacaaggtcattcactactaagtggcagtggttcacactggagcctgcattagaatctactagagggcttcttaaaacccagatggctgggttccactcctagagtttctgattcagtccaactggggtggggcccaagaagttacatctctaacaagtttccaggtgatgctactgctccagggatcacactgggagaaccattggtaagtggtaaagttgggatttggtctcaaacctattggtcttagagcttgacctctcaaccatgacactgtgcttcctataagaatagccttcaatagagtgaagtgaggagcagagtaggcagagttaggaagctttcgtgtgagctgcttttgaaaaaggcaaaacaaggttggggaggtagcacagagcagccaaagctgttgttcccaggctttagtgtacaaagaatcacctggtatgcttgttaaacaagcagatttcctgtttcattcccttcttcccaaatctgggatggggcccaggcaagccatctgcattttaaacagatagtcagggtgattctaaagttagtggtctggagaccacacacagaaataccaacccagcaatatatccaagggatgccaaataaaagtccaggtggctgaccgggcgtggtggctcatgcctgtaatcccagcactttgggaggctgaggcgggcagatcacctgaggtcaggagttagagaccagcctggccaacatggtgaaaccttgtctctactaaaaatacaaaaaattagccaggcgtggtggcgcatgcctgtaatcccagctactcaggaggctgaggcaggagaaacgcttgaacccaggaggcagaggttgcagtgagccgagatcgcaccactgcactccagcctaggcgacagcgcaagactctgtttttttaaaaaaaaaaaaaaaaaaaaaaaagtccaggtggttatgaagaaaacagacttgacctaaagttaaagggtgagcatcaggcccaaactgaaagggcctctacctttctagggaaaggaaagggaagtagaacttactatatatctgtatatatctgctcgatgtgatgctctgtactctttgcaaagaccatgtgagatgactattattgtatcctttctaaagaggagacaaaggagacttgcagaactgaaaagtaacttgtcaagtgtcctagttgactgggtagagctggaatttgaccccaagtccattttgcctcaaacccctgctttgcctactgcaacgatctgccttatgaatcatggtccacagcaggccatggagctaagtgaaaacatgctcagacagtagctgtgatcttctgtagtggcaggactatgccatgctcactgctgtttcatcagcatctagagaaatacttgttgcatacgctgcggtcaataaatattttgtgagtgaatgaatgaaagtttggaggcaggcgggtcacctgaagtcaggagtttgagaccaccttggccaacatgatgaaaccctgtttctactaaaagtacaaaattagccaggtgtggtggtgcatgtctgtagtcccagctacttgggaggctgaggcaggagaatttcttgaacctgggaggcagaggttgcagtgagctgagatcgagccgctgcactccagcctgggcgacaagaatgaaacttcacctcaaaaaaaaaaaaagtgtgggacaagagaagtagttcttcctctggaaatagaagcagagagagtttgttctggcattttgagctggtatcaagctaactgggtgaaattgggcacctgtacattgcctgctgccaagcagtttaagcagtaataagatggtggtgtattttgaaataatacaggtcattagagggggagtgagatggaacaaagatgaactcctgatctttagaagagaaattctgcccactaacctgaggtgatgaccctgggaaattatctaagaaaatccgtgatgttgatgagtacctagccagggtacttgtgttagaaatttctttatttagaacttcaaatatcaggccgagggcggtggctcatgcctgtaatcccagcactttgggaggccgaggcgagtggatcacttgaggtcaggagttcaagaccagcctggccaacatggtgaaaccctatctctactaaaaatgcaaaaattagccaggcgtggtggcgtgttcccaggtgatgctgctgctgctactagtcctgggaccacactttgagaaccacagcataagagcaactgtcggcagtggttagaaggagtggtagggagattatccaatatcataattgttggagcattgtactgttagcagaaaagctcggagaatttttaagaatcttgctgtttgattaccatttaagaaaacaagaaaaacgttacttttttgaagggtttgttcaagagtttcaagaagggtttggtcaagaagggtttggtttcaagagtttcaagaagggtttggtttcaagggtagtaagcaatttacctgtttgtggcactgtcttgagcgtgccctcaaaaaagacaaaacatagcagaatttggtatttgataatgctcttcaagattatagttttttgtttgtttttcttttgtatttttagtggagctggtttcgccatgttggccaggctggtcttgaactcctggactcaagtgatctgcccatctcagcctccctaagtattgggattacaggcatgagccactgtgcctggcctagattatagctataactggactctcttaccatctcctacactagccatattttatgacataatataattgcctaaaatgtgttttacaaatttagaactgcccaaacaggggctgggggtacaaattctagaagaggtaatgacaaactctgcccatagctcttagctttttgaccttgtttgtgaggtcacaagggtgatgaaacttcaagagaaagaacagaataaatcaaaaaagcaatcagaatcggcacctttggtcttagctagtccagctgtggagctgtgcacatacacagtgttgtatgtattctgatgcatggagaataaatcctgtcttgacataaaggaaaagtccaggagattgtttcataggttccttttcattaaaactgcctttcttttctctctttctttctttctctctttctttcttttttttttttttttttttttttttttgacaggttgttgctctgtcacccaggctggagtgcagtgttgcaatcacagctcactgcagtcttaacctcccaggcccaagcaatcctcccaattcagcctcccaagtagcttggaccacaggcatgtgccaccatgcctggctattttttgtattttttgtagagatggggtttcactatgctgcccaggctggtctcaaactcctgggctcgagccatctatccaccttagcttcccaaagtgctgggattacaggcatgagccactgtacccggccctaaactgacttttcttaaagggaatctcggttctgattttctactttccttttcaaaaaggaagtttgtattatctgtttccacagtgtgtagaatttccctgactacatttttcaagagccgccttaatgaatctgccttattcatgtatcatctgtgatgtaatttacttaataatttttctttacatatactcactgttctaaaactttaatgtattttaaaaagcaaacatcaatcactatcatttacagaaaatagtatcattagctagtagcaatggctaatgataagcagaaggtaactacaaagtttatataaaactacataaattatataaaataaatatgtaactataagattttaaaagcttaacttgtgccactttttttgcacatcagttatacaaaaaacagtactagttgccataattactgggtgtttaataatagtttctgttttgttttaaagacaagaattcatatcagcatgtagttttctagcaggtaccaacaaggtagaagaaagagtggtgagtttgatttgcactcaaacatcatcgtaaattggttgtatgacattgggtaagatgcttaacttcactgagcctccatttgcccatccatgaaatgataagtctactttcacctggctccctcatagggttgatgcaaagattaagtgaaatacatgtgttttgtgaattgtgtgtatttctaaggtactgtttaaatgccttaaaatagccacaatccaagccttgttaatagccataatcaaagatgatcaatcactattttattgttgcttgaatctgaagcaaataccaaaaaacgcctaacataccccacagtagtgtgaatttaaacgtaacgtggttggtgattacctcctgtttggctgtatggcaggtgtgtgtttaactttttaaacaactgccaaactgctttccaaagcgattgtaccactttaaattcctatctgcagtttatgagcattccagttgctctgcattctcaccatcacttggtatggccaattaaaaaacattttttagccattctagtgtgtatgaagtgttatctcattgtggttttcgtttgtatttccctaatgactaatgttattgaggatcttctcttgtgtttatttgccatccttgtatttattttctttagtgaaatgtctgttcgatatttttgctttatttaactgggtggtgggttgttcatcttactgaggtttgagagttctttatatattctagatacaagtcctatattttgcaaatattttctcccagtctatgactcaccttttcatttttgtaaaaatgtcttttgaagagcaaacgtcatgagtctcacaggctgcatttaaggtgtcaccccaggctcagttctcatctggaggttaactgttgttagatctgcttccaagctcactcaggttgttagcagaatttatttccttgtgactgtaagatcaaggggtgagcttcttaccagttgtcggccagaggccaccctcagctcctagaggccacctgcaggtccttgccatgtggccctctccataggccctttcacaacatggcagcttgcttcttcaaagccaccagtgcagaaagacagtaagtctgctagcaagatggaccctttttgtttctttttgtggttgttgtttttgtttttttttgacaaagtttcattcttgttgcccaggctggaatgcagtggtgtgatctcggctcactgcaacctctgcctcccgggttcaagagattctcctgcctcagcctcccaagtagctgggattataagcgtccgccaccacgccaggctaattttttgtatttttagtagatacggagtttcagcatgttggccaggctggtctcaaacttctgacctcaggtaatccacccacctcggcctcccaaagtcctgggattacaagtgtgagccaccacgcctggccaagatggagtcttataatgtaacataatcatgggaataatgtctaccacctttcccatattctactgattagaagcaagttacaggtcccacacgcacttcaaggggtgggaattacacaaaggcatgggcaccaggaggcagagatcattaggagccaccttaacgtctctccacgatagccatgcaatagttgtactctgacatctttttttgttttcaattggctcctggtcattgccaaacctccagcttcacaggtcagtggtatctcacatagatgctctggaatctcacatagatgctctggagagtccccagatgcctaaaagcatatccagaaaaatctcaaacaaaagattaaaacagatcaacatacaaactaaaaagccatactctgtttttttttaaagctttattatagagtatttcaaacacacacagaagtagaacaatataatgaaccttcctgtgcctgtcactcatacctaacaaccactaacccatggccagtcttgcaccatgcacacctctgtctactctgtcctcttgaatgatttgaaacaaaatcccagacttcctagaattctgtgtatatgtctgaaaaataagagctctggttttattaaacataaccactgtatcatgatcttacctgaaaaaacaataattccttgatatcaccaaatattcagtgttccaatttctaattatcttatgtcatcatttatatatagcttgtttgaacccaataatgtccatactttacagtaggttgatatgtttttaaaatctctttcaatctgcagatccccctttcatttctctttttctttctctctctctcttttttgccttgaagtttatttgttgaagagatgaaagatcagggtccttttttggcagggaggggagtcctggagaatttcccacagtctggaaattgctgacacaccacaatttttaaaagtgagcttattgcaaaatcaactttgtaaatactcttcagatttactaaatggcctttttctcagtaattacgtcttctttctttacttttctttcctccctgcttcctgaattcatttctcttgatcacctctgaatcaataacaaaaagttttacaaaactgccatctgctttcccctggggtttatatcttaaaacaaattttcctcaattgaattcacattgaataagaacattgaaagcaaggctccctcattagacagtttgttatttcaaagcattttctatttactgtgccttatttagaatacagtataatcctatgaaggcaattctgtttgttcaaatttgtgtataattggaaataattgcaattccctatctgacataaagtctctcaactttttttattagagaaatttaatttattagaaacattgtatcatctgaatctattaatgtaacatttctttatgttccaaattaatgaggttgcattgcatcaagaaataatcacaattttaaatctaagtcttaaagatcatttaacagaagttggcattgatttcttttttaaatttatttttataacatcaatgtaatacatgcatatatatatatatataatttgagacacggtctatctctgccacccaggctggagtgcagtggcgcaatcagctcattgcagcctctgcctcctgagttcaagtgattctactgcctcagcctcccgagtagctagtattgcaggcgcctaccaccatatctggctaatttttgtatttttagtagaaacagggtttcaccatgttggccaggctggtctggagctcctgacctcaagtgatccacccctgcctcagcctcccaaagtgcatggattacaggcttgagccaccacgcccgactatttttaaaagtcagtagtactcccagcttataaagaaaactagcggtccctttctccaccttcttcacccctgattcttattccctgtaggcactcaacacttgacagtcaactttccataatgttgttgacatctctcatccattgtcattgcctttcttgttttctctgcccttgggaggattatatctttttaacttaacttttaactttaacttttaactcttaactctgtaacttttaactcttagtaattgttgtggtgtttctgggagaaagtagagataatgtgtatgttcagttcaccatatttaactgatggtctttgtatttccttttaaagaacattattagctcacgcctgtaatcccagcactttgagaggctgaggtgggcagatcacaaggtcaggagtttaagaccagcctggccaccatggtgaaaccctgtctctactaaaaatacaaaaattagctggatgtggtgctgagtgcctgtaatcccagctacttgggaggctgaggcaggagaattgcttgaacccgggaggtggaggttgcagtgagccgagattgcgccactgcactccagcctgggcgacagagcaagactctgtctcaaaaagaaaaaaaaaaagaaaacaaaacaaaaaacactattgtggccacatatgtctctttccttctcactgcaagaataaaatgtctctatgttgtttgtagccgtggagatgaggtgacaagggtgcttagaatgagagcactttgatatgagaaactacttctttctcctgtcatccatttttgaatcttcttggattttcacattctagttcctttgttgagagtctagaaaggtgtcaaggttggcaaaatacatagaattttctatataaatgtaggaggcatcttccagagtatcatgatggggatataacagagctgcaacttccttcctccaaccagttaaaaagaataattttgtgacttgctttgtctaccaaattgatggaagtctatacccaatttctctctctgacttgaaggggatgggtctttggcctggctgagcaatagtgttatcctggtctcctggttcctggaggtgctgtactgaagtgtgtccctcttcctcttggaacagcactttttagagcactagatgccactgtctgtgtgacctcttcacttttgacctttctccctaggaaggactatagtgttggttgttcatcttcagccctgagcaccacttctacatgcaacattacatcctgactctcctccctttgaggcgtatgtccctaatctcttattataccaaagaggttagggagtggccttgcagtggtatgctagtaaaggtttaacagctggtcctctagcgggaaataagccctgatttgtagcatttgccaacttctgtcgtggaagcactctatcgtggctgacttcaggctaccaacgtgacctggagttgggaagaaaggttgtaaggtgagccatgtgaacagattccagtacatcgttgcctttgagaacagggacttggggtcttcattcaggactgccacacccaaggatgaagccatttgccttttccattgagctcctcagttactcctgcctacgtgttccagctgggctgactctgccggctcaggcacctagactccactctgggtcaagagaactcctcagtgctctgtttttgtctcttctgttggctaaaatagtgtgttccctggtttgatcttaagtttgttatgtttttgctctgctttgatgtcttcagaagaacccctttaaaatcaatttcgtgcactgatatgaaactgatggtatgtagagattgtgtcttatccagaaagtttcttacgactgatagaaggtaactgggattcctcattctgcagttctgttaacagtgttttctttctcccacagctgacaggcctgtcagagtatacgccgatggaatatttgacctcttccactcaggtcatgcaagagcccttatgcaagcaaaaacactgtttcccaacagctacttgttggtaggaggtaagaagtgcattttctttttgtctagaaaactcttttattgtatgctttctgaaaagagcccctttcagagttccatcagtaaaaatctcacattgttaatgcttccaattcagcccatactggctcgcttgttcactgcctgaaatttaaaatgatgtttgaaaaaccataggggaagttacatcatgggattgtataaccctgatcctcagagagagatggactgatagtaccaccaagggtaaatgcttcatgttttccattaatgcctttctattagtgtttaaggcttgatccaaattatgttcctaaaattttctagagggataagagaagcaatattattctgatttcaaatctcaaagaactaaagggagttaggatgatgaagaacaaacaaggtcatcgtctatttcttttgtgtgacctgcagcacttaagacaatgttgtgctaacactagtggcttgtaacagccccacttagttgaatttgtagcagtgtgttaaagacatggagatttatataccgaggtaatcttggttcacaacgaagggaccaatttactcgctaagtctatggaaagagaaggatcgttagatgtggactgaaattttcctcctccaggaggcctatttctttttggctaaaagggatagtacctgactaggaagacctgtatttcacttgtgcagcttcaggaaggagcatattcattcagagtaatcagtttttgtggcatataaactaggcaccatcaagtcttacacctctactgggggaaaaaagtactggtaagagactacataactgttttttaaagaattttgttaccttctgcaattaaaaaccactttgtttgtttgtttgtttgtttgagacggaatctcactctgtcgcccaactggagtgcagtggtgcaatcttgactcactgcaacctctgcctcctgggttcaagtgattctcccgcctcagcctcctgcatagctgggattacaggcatgtaccaccacgcccagctaattttttttgtatttttagtagagatggggttttgccgtgttgtccaggctggtcttgaactcctgacctcaggtgatccacccacctcagcctcccaaagtgctggcattacaggcgtgagccactgtgcccagccaaaaaccacttgttggacatttaagaggaactcttctgcaggttttgccaagggtggtgaccacaggaccattgaatggagttctttccagaaggaggaaatggtggaaggcaatggttactgggcaagtcatgcagagggaacccaaaacaggcagagaacccaacccttgcttacttccctttagcctgaaaaccattccttgagagagcactaccacctggagtctggtcctaggctactggggccctggagagacctctgcagtgtttgggctttggtcatttgggtggcctaagtttggaggtggttaggtgtgggtcacagttaacaggaacactagctgtggccctgggttatcacatccaaagtaagataaaaggaaatgtgtagttttcagtacgttcttgtaaattggaggaggcagtcagttaatatcagcagctctctaggtcattaggcaacaatggtttcactgactcactgatttcttcatctgacaactttcttttttttttttttttttttgagatggagtcttgctctgtcacccaggctggagcacaatggcatgatctcggctcactgcaacctccgcctcccaggttcaagtgattctcctgcctcagcctcccaagtagctgggattataggcgcgtgccaccatgccgggctaatttttgtatttttagtagagacggggtttcaccatgttggtcaggctggtcttcaactcctgacctcatgatccacccgcctcagcctcccaaagtgctggattacaggcacatgccaccatgcccggctacttttttgtatttttagtagagacagcatttcaccatgttggccaggtctcgaactcctggcctcaggtgatccacccacctcagcctcccaaagtgttaggattacaggcgtgagccaccgctcccggccccttcatctaacaactctttattgaactcttactatgtgccaggcatttttctgtacactggggatgcagccatgaacaaaacagactgtctatgtcctcagagaacttgcagtctgagggagaggcagtcattgcccactaaacaagtaaatatgtagtagtggtactatgaagaaatataggaaaagagaaaagagtgactgggcggaggaaggagggatgttttaggtataaaggtcagggaagacctctctgaggaggtgacatttgtgcagagacctgaatgaaataaaagcactcaaaagccagaacatccagtcttccttgtgcaggattctcaccagtcaagacaacagtgtgaggcaagcagagaagacatggtgacatgttagttttttgatttgtgtatcttaaggaggctttccataaaagcacagatgattcagtactcagggaaattaatatgggcagaagtttggagccaagaaataaagcagaagagaaggagaaaaatttcaataagaaatcctggactttttagcagctatagcaaagggggccacacagtcattctatcactctcaaactctagaagctgaattgtaccatcaggaagaactagtttttcctgcctgagttctgagataactgtttcagagggtcactgtgtaaggggcattgagtaatccaaagaacgatgtcctctatagtaggtttacacagaatttcagatattcccttaatggctattacatgggttgtggaagtcaagggcatattgaactacttggatgaccatgagactgtatcctttggtaagtgacaaggactggagtacaggaagaaaataaaacaatacagcatcaagctataaagaaatagtatgtagacttctgggaacagtgacagagtaagagtgaaagctgggcatggtggtgcatgcctgtagtgccagctacccaggagactgaggcaagaggatcacctggacccaggagttcaagggtatagtgagctatgatcgtacctctgcatagctattgcattccagcctgcacaacacagtgagacttcatctctaaaacaaacaagaaaaacaccaaccatgggcaacacaaacaataataaataatttcagtgtgttcttttctctgtagatttcttattcttatcatctcatttaaaataatcgaattgtaatactatgaaatatcttctaaccactctgctaataaaattcagtgacatcctggctgggcgcagtggctcacacctgtaatcccagcactttgggaggctgagttgggtgaatcatctgaggtcaggagttcgagaccagcctggccaatgtggtgaaaccctgtctctactaaaaatacaacaaaaaattagcctggcatggtgctgcacgcctgtagtcccagctacttgggaggctgaggcaggaggattgcttgaacctgggaggcggaggttgcagtgagccgagatcatgccactgcactccagtctggaccacagagtgagattctgtctcaaaaaaaaaaaaaattcagtgacatcctgtatttcatatgtctccattaatttaatatttgatcccaagtctgttaaatggaatctctaacctcctgtgtataggcagactgctatgggggcatggtataagagctcaaatcccaagagtggcattgctgtctgggtgtgatttcccaaatggtgaatgcctcttggtaaaattgtaaacaaaacaaagtgcaatcttcctttgatgtacatagtaattgccttcctctaaaattctgtgtctatcataactgttgcagaaatactttgtgattgtatgcaaaacaaaggcagattctagactcaaataattttatttttctaagttttttatttaatcatttttttttttggagatagggtcttgctctgtctcccaggctgaagtgcagtggagcaatcacagctcactgcagcctcaaactcccgggctcaagtgatcctcccatcttagcctcccaagtagctgggactataggcacatgccaccatgcctggctaatttttctgtttttgtttattgtagagatgggatttcactatgttgcccagactggtctcaaactcgggctcaagtgatcctctggcctaggtgtcccaaaatgctgggattacaggcatgagctagcacactcaacctcaaataattttaaatattatgcagggactttcaaaaatcttgcagggatgtgggaaaattctcatgcagagctgccacatgcattgcaagatgactagcttcattggcccctgcccactgaatgctggtagctgcctccaaccattatgacaattaaagatggcccacagatttccaaaatgcttcctagagaatgatgaaatccttgttgaggaccactgtcttagactaggagtcttgaaattttgttccccacaatctctaaaagaattttgaaaaatctgtataccttcttatacagtttaaagcagatgtctaaaatttatatatcaggccgggtgcagtggctcacgcctgtaatcccagcactttttgaggccgaggcaggcagatcacatgaggtcaggagttctaaaccagcctggccaacatggtgaaaccccatctctactaaaaatacaaaaattagctgggtatggtggcaggtgcctgtaatcccagctactcaggaggctgaggcactagagccacttgaacctgggaggtggaggtttcagggagctgagattgtaccactgcaccccagcctgagtgacagagcgagacgccatctcaaataaataaataaataaataaaataagtaaataaaatttagatatctgcttcttaatttaagtagttataaaagatgtaaattctggaatattgtgagtattagcctttttaaaaattaataaactttattttttagagaagttttaggttcacagaaaaattgactggaaagtacagcgaatccttgtatactcctttctcgcacaggcacaacttcccctactatgaatatcctgccccagcctgatgcatttgttacaatccattagcctacattgacacatcattatcacctcaagtccatagtttacattagggttcactcttaacgttataccttctatgggtttggataaaattttacattgtccaaactcatagatgtacattgtataatgacaggtatccacaatgatagtatcatacagatactatttttactgccctaaaaatcctatatgctctacctattcatctcttcctccctgtaacccctgacaaccactgttctttttagtgtagttttactttttctagaacatcatataattagaattatacagcatgtagctttttcagattggcttcttttacttcataatattcaattaatgctcctcaatgtcttttcatggcttgctagctcatttctttttggcgctgaataatgttccattgtctggatgtaccacagtttatccattcatctgccgaaggacatcttagtggcttccgcattttggcaaatatgaataaagttgctataagcatccatgtggaggtttttgtatggacatacattttcagttcatttggataaataccaaggagtgtgattgctagactgcatggtaggaatatgtctagttttgtaagaaactgccaaactgttttccaaagtggctgtaccaggagtgggtatagctcagaggtagagcattcaactgcagatcgaagtggctgtaccattttgcattcccaccagcaataaatgagagatcctattgcgtcatgtccttgccagcatttggttgtatcaatgttttggacttttgtcattctaataggtgtatagtaggttgttttaattttcaatttcctagtgacatatgatattgaacatttttcatgtgcttcctggccatctgtagatcttctttggagaggtacctgttaaggtctgtagcccattttttaaaatccagctgttttttttcttattgttgagttttagagttctttgtatattttgggtagcggtcctttatcagttgtatcattttcaaatatttttcgcccagtccatgtctttttttttttttttttcgagaaagagtttcgctctgttgcccgggctgcagtgcagtggcacgatcttggcttactgcaacctctgcctcccgggttcaagcaattcttgtgcctcagcctcccgagtagctgggattacaggcatgtgccatcacacctggctaattgttgtatttttagtacagacagggtttcaccatgttggccaggctgttcttgaactcctgacctcaggtgatccaccaacctcggcctcccaaagtgctgggactacaggcgtgagccatcgtgcccggcccccagtctatgccttgtttcctcattctcctaacattgtctcttgcagaacagaagtttttaattttaataaagtccaccttatcaattgtttctgtcacggttcatgcctttggtgttgtatctaaaaagtcaccaccatacccagaagaaacccatctgggttttcttctgtagagttttatagtttggcattttacatttacatatagtttggcatttacatttgatttttgtgaaggatgtaaggttatgtctagattaatttttttttttttttgcatgtgaatgtccatttgttccatttgttgaaaggtctatgtttgcttgcctttgctcctttgtcaaagactggctctctgtatatttgtctgggtctatttctgggctttctgtctgttccattgatgtatttgtctgttctttttgccaataccacactgtcttgattactgtagctttatagtaggttttgaagtcagatagtgtcagttttctgacactttcttctccttcaatatcaatttggtttttctggatctttttcctttccatataaacttttatttttatttttatgtattttttaagagacagggttttgctctgtcactctgaggccctacttgagctcctggaggtaaaacccacaaaagtatttgtcccctggcttcttgaactcttagacttgtccacactgaggtgccagcgatttgtcagtttaaattttcctatcccagcactggttcctggggaggtagctctgcttgtgggtttctgctctagtaagctaatattctctctatctgcctgtttctctctccaattttgggagtagtggtttgccctgtgacctcagttctctgatggatctaagaagacctgtagatttgtcagtttgttcagtttttacttgttgtcaggaccgagtggccacttttaagctccttacctaccagactggaaaccagaaatccaatattgacattttaaaacaaaattatgggccaggcgcaatggctcccgcctgtaatcccagcactttgggaggccgaggtgggtggatcacttgaggtcaagagttcgagaccagaccagcctggccaacatgatgaaaccccatctctactaaaaatacaaaaatactagccaggcgtgcacctgtagtcccagctactagggaggctgaggtgggagaatcgcttgaacccaggaagcggaggttgccatgagctgagattgcgccactggactccagcctgggtgacagagtgagactccatctccaacaaataaataaataaatacataaataaaaaacaaaattgttaccccatcactttaatgcatctattggcatctaaatactataatgctttgaaatatatcatcaacaatttacaaaacatataacaagctattttttaacttttaaatatttataagtttcattttttccctcaaacttatattttcattctgcttctctcccataatttttcctaatgtgatgtgttttaatgtttgcaaatcttttagtgatcactgtatcatacttctctgaaacaaaaatatgtatataaattagagcataactaaccaaagcaccacattatatacactttgataaataattgttaacatagacataaatttggacagcaatgtatctcttaatgagatgaatagtatgtacctggagatgtacttatggatgaatataactgactgctagaatgaggcagggtttaacatcaattttatccctattttttccttgtcatagttataagtgctgaaatatgttgttcatgcaaatgtgtagatagaatggaaggagtttgttacagtgatgccactcaattctttgaacttctgagttatttaccaaaaataacaacataatttattattattattgccatcaaaagtaattttaatggtctatcaagtgacaatttgttaagatcctccttcaaatttgttgcaagcaatggattagaaatgacctgacctgcaaaaggatttgttgccaagctattagaatcatttgctttttctctttctgggacttctaacaaaaggctatatcaagagttattaaatgactcttaattatatcccttattcttttacttgaaagcaacttattcaactagatatagccagaaaggatttgggaaatggaaatattagtaatttaattacatcattgccaatcaagtaatttttgataaaatgcttttatcatttgcttacaaccttttttaaaaaacaaaatctcagggctacagtttcagattactaactttgcagaaaacaccatccaaccaaattggcaaaaccagtcctcattgtcaaacctactaaaaacctacaaaccaagaaaatgtcttttcaattcaaatgcattaatgtattttcagttcaaatgtattaatgtatttcaagaagctttataaaaaacactcaaaaataaatgatagaatggattatgtaaaatagaatcagtcaagattaaaatgatgtagatctaatataataagttataaacaagacaagacaataaatcaatgcacttaatttgtagtaatgcaatgtaatttatacataaaattatgtgatatttatacgaagaagagtatgatttttaaaaggcatgttattccttctctaaatattggcacacgtgtgtgtgtgagtgtgtgtgtgtgtgtgtgtgtgtgtatatatatatcaaattctagtgtttgccttttgggaataatcaaataaatatgaaaaacagaaatagttatctttagtagataccatgactaaacttttcctatgtatttaaagatagaaagggggcatatattattaaaaagtaattggtctggaggcagataataattttattttttgttataaagaggtagaaaataaacattatagacaatgagatgaattaggatgacctgtaaatagaataaatattttatgatataagttgataacacaggtttttaacttcctttttaagtaatgcgtatgaagcctgtaaaaaattatgtaaatgttttacccatgtgtctattccaatgtatcttgaaaaatttgataattctagaaaatattctagtcacatttctaagaagcagcagtaccagcctatatagctttggtttattgaagtgattttcaagtaaatagctggaaaaaagtgcttactcttatctacaagagaaaagccatttttaggattcaatatgagtgttaagaatagctgaaaaaatgcttacccttgactacatgaaaaagccatttttttagaattcactatttctttccaatgctccttttgctttgagttcttgggccttatccctaaagatccatgtgttttttgacaatagttgggagaagaggcaaagttgttgggcaaaaatttgcattattctccactctaccatattgagtttctaacactaggcttcacctgtaacagaaatgtgtgtaagacagggaaagacaggaagctttcataggttcatggtgctttgaatggtcactaactgagatttccatttggtttgccctgaaggctaaatcgccctccaccccttccaatgcaacatattaaggtttgggtggtgcctttcttttgtaaagtggagtaagcatggctttggacccagagactttcttgacctagttaatattaggaaagtgtaccactggaagttgaatctggacattgattcgtttaaaactagctgttcatggataccttttgaaaagtctatgtggctgggtgcggtggctcatgcctgtaatcccagcactttgggaggccgagtgggcggatcatgaggtgaggagttcgggaccagcctgaccaacatggtgaaaccccgtctctactaaaaatacaaaaattagccaagcgtggtggcacacgcctgtaatcccagctatttgggaggctgaggcaggagaattgcttgaacccaggaggcggaggttgcagtgagccgagatcacgccactgcactccagcctgggtgacagagcgagactccatctcaaaaaaaaaaaaaagaaaagaaaaaagaaaagtctgtgtgtgtccatgagggtatatgtatcgtagtttaaggagacctttatcttagactgtctttctggagaatgacaaaccaaccaacttaatggcagacaattctatactgaggaaagttagggaggtcttcaagaataggtgtcctgtgttgttggttgaaaggctggatcttgattactgtatgtgtggtcaacatgtaaaatgcttacagtgagttaaatgggcctgccatattaactagggtcccctttccatatgcaggtaggtttgctgtaggagttcccttgggtggagcgaagacttcactcatgaaaccactttggtcagggcaagtatggggacaagtatttggtagaaatacttggtatttgtcagaaatcatttattaaaggaccagaaactgtgataactggaggtactatagtctatttctcaaccttaggcagtaaaaggcaccacaatcgtcatggttttgccctatgattataacaccagcactttttttttttttttttgagatggagtctcactctgttgcccaggctggaatacagtaccatgatcttggttcactgcaagctccacctcctgggttcaagtaatcctcccacctaagcctccccagtaactgagattacaagcatgcaccaccacacctggttaacttttctattttaagtagagacagggtttcaccatgttggccaggatggtctcgaactcctgacctcaagtgatctgcccacctcggcctcccaaagtgctgggattacaggcatgagccaccgcacctggcccaatacctgcacttctaattttttaagcatgtagccagtaataatttgaaaattcttctatgcaagcttaccttgttggcattattttagtgaattgagactctccacttgtaaagctcttttttccttcattttaatttacaagtttgtgtcatttaaaaacaggccaaggaattaaaatttatactagtgtgtttttttccctaaaaaaatttttaaagagtcaccaaatagccacctctgcttcgcaggagggcaataaaaataacaacagtaaacatactactactactatagaagacataaagattactccacaaacttgtgtttattttattatattttaattggaactaaatattctttaagagtcccttttgcctgactggtaggaaattcagtctcagtcttttttttttttttttctttgagacagggtctcactctctcgcccagactgaagtgcagtggtgtgatctcggctcactgcaaactctgcctcccaggctcaagcgattctcctgcctcagcctcctgagtagctggaattacaggcgtgcaccactaacgcccggctaatttttatgtttttagtagagacggggtttcaccatgttggcctggctggtctcgaattcctgacctcaaatgatccacccacctcggtctcccaaagtgctgggattacaggcatgagccactgcgcctggcctagtctcagactttactgggctctctttacctccccagagtcaaacaagtgtccacaatgtttatagaaacaggagcggggcctccagtcttcaacccagggctatttttgcactgccctcactgtctgagcccagataattactagaagggagcagattcattgcacctatcacagttcagtcacctgcagtctgttcccaggtagaactcccatgcctagggcctcacattctcatctctcttgaggtcctgccactggcatctgctgcttgtgggatccatagacatttggccctttccctgcaatttggagagatctcctctctcattgtcttcttctttccagaatacccctcaagttgctctggcttcaggaaaacagcagccaggaaggcaggctgtctactagcaacttgagctcacagcacctacaaaggagtctgtaccacggggccctcatacctgcttggagtagggggcagggaaaagacagaacacaaaatctgaaggaatagatccatgagtgatcgtattttcctactactattcgtaaatggctaacattattcagcattactctctgctcataaagatgatcaaatttaattctcaaaacttcaccatgttttaaagaccagataactgaggctcagagagtttgagtaacttttccggtaatagcagagctgggattagaacccgagtctgttgggctcccaagctcaattcctatgttgtattttctctcctgtgggagcacagtgagctgccagcataggttagttgcagcatgagttcccagatagctcaatgaattcatccatggaataccgctgcccagagctctccatctggttgtcagagtgcatttgccaagactcaagaacaacagtgctgctttgggcgtaattaatgtttagacaataactggtcagcatgttcagctgcttcttgaggtcactcctgggataggaaaataggaccctgtattggcataaacaggatgtttgttttctttgtgctctatcagtaggccattatctcggtcatgtagaagttataccaaattgctcaggtgcagattcagaaagggggaggatgtggcacggcctagttttgtgctgtttaaaatagaaaatggaaaatggatgaatctgaaatccatttctgctcaatatgattctcagggtggtattttaataaggtcctaaaagaacattcaaaaagtcttagattggttttgaaatcatattgcatggcccataaagaattcctgtttatggggtcaaaaactaatatagtcaataaatcaacacatagttattatggccctactacctgtccctcctgcccaccttcccccccacctctgggcataatgggtgatttaaagacaggcagagctcttgactcaagttatttataatatgcttcagggttttcaaatgttgtcttcatcagaatcatctctgaagcttgtcaaagacagagctatctgggccccactacagactcactgaatcaaaaatctcagggagtgagctgggtttctttacatgtgtttaacaagctccttgggtgattctgatactcatcagttttcaggccagacatatggttgatgttgttttggtaatataaacttttataatagaaaacatctcaggaagtatgtataggagatatagaggcatatatatatatatttatatgcatctagaagctcattagtctctcctttgcgtgtatgttgttgaaacgttcctgtaggccaggcgcggtggctcacgcctataatcccagcactttgggaggctgaggcaggtggatcacttgaagtcaggactttgagaccagcctggccaacatggcgaaaccccatctctattaaaaatacaaaaattagccaggtgtggtggcaggtgcctgtaatcccagctactcgggaggctgaggcaggagaattgcttgaacccagaaggtgaaggttgcagtgagctgagatcgcgccattgcactccagcctgggcaacagagggagactctgtgtccaaaacaaaaaaagaaaggaagaaagaaagaaaagaaaagaaaagaaaagaaaagaaaagaaaagaaaagaaaagaaaagaaaagaaaagaaaagaaaagaaagaaagaaaggaaagaaagaaagagagaaagaaagaaagggaaagaaggaaagagagagagagagaaagaaagaaacgaaagaaagaaagaaacaaagaaagaaagaaagaaaagaaaaagaaggaacctgtagataaatataaatctattattgtaaataataataaatatttcttgagtatctatatgtatcaggctttgttaattcattcaacaaatattgttaaaagcctactaggggccaggtatggtacatcagaaaatgaaacaaaagtccctgccctcggggaatttataggggaacaccaacaataaaactaaataagacagctacatgagacaagtgtcatggggagaagtaatgcagcagaggatcacaattcagaagagggtgggtctacttgggaggctgaggcaggagaatcgcttgaacccgggaggcagaggttgcagtgagccaagatcgtgccattgcactccagcctgggcaacaagagcaaaactctgtccaaaaaacacaaacaaaaaaagaagagggtagggggaaagacttgagggagaggagaaggtgagctctatgagtatttggagcacaactattccaggtttggagaatagtgcaaggcccggacctgagaagaagcattcaagaaactgcaaggccggggagctgggatacactaggagactggtcagggaggcaaggagtgggcagaggcgtaggtcttgtcagccactggaggactttggttttactctgaatgagacaggaagggttctgaatttgggaatgacacagactgacaagcttcaacaggctcattctggccaatgagaataggttgttgggagtgggcaaggctggaatcaggagatcagttaagaggctactgcagtcatccctgggagagatgatgaaggggtggggatgggagcagtggaggtgctgagaaaaacatggcttccgggtgtgctttgaaggcagagcctgcagttttcctgatggcttgggtgtggattatgtgaagggactacaaaagaaggttttccaaggatgctgagtgtgactgttggctgtgcttactctgtggccagatttgattctgggtgtgggtcatcattcagttccaagaaaatgatcatatttttgttcttaaaacacatcttgtgagattaggcagtatttgtcttcctgtgtctggcttatttcacttaacaaaataacctccagatccatccatgttgccataaatgacaggatttcattctttttcatagctaaatagtatttctttgtgtttatataccacttatatatggaatctaaagaagctgatctcatggaaacagagagtagaacagtggttaccagaggctggggaaggtagatgacgggggacagggagaagttcatcaacgagtaccaagttacagttaggaggaataagttctggtgttctattgcacattagggtgactatggttaacaatattgtatatttcaaaatagctataagacagaattttgaatgttcttaccacaaagaaatgataaaggtatgaggtgatggatatgctaaatatcctgattagattattatacaatgtatacatgcatggaaacatcaccctctaccccataaatatgttaattattatgcatcaattaaaatttttaaattaaacacatattgtacacttaacattagtgaatttgttggctgggcacagtgcctcatgcctgtaatcccaacactttgggaggctgagaccggtggatcacttgcagtcaggagttcgagaccagcctggccaacatggtgaaaacccatctctactaaaatacaaaaattggctgggtgtcatggcacgcacctgtaatcccagctgctagggaggctgaggcaggagaatcacttgaacctgggaggtggaggttgcagtgagccaagatcacgccactgaactccagcctgggtgacagaacaagattctgtctcaaaaaaaaattagtgaatttattgtaagtacataatattttaaagaaaaaaaaatttcattgcaaagagcagtcagggtagttctgactggccaccgcaaggctctcactgggatcttggtaaacagggactgtacccacaatgatatttcttcctgacacataggagatcttaggaaagctgccttggccaaccaaaagataggatagtgaatagtatttattgttcagtttgtttaaaagcactttttttctaagttctcgaaacatcttttctaaggctgatagtggaagatatccccatttgagggttcaggaacctgagatctagaaaatataagagatgtggaggccgggtgtggtggctcacgcctataatcccagcactttgggagcccgaggtgggtggatcacaaggtcaggagatcgagaccatactggttaacacagtgaaaacccatctctactaaaagtacaaaaaaattagcctgggtggtggcaggagcctgtagtcccagctactcaggaggctgaggcaggagaatggcgtgaacccgggaggcgaagcttgcagtgagctgagatggagccactgcactccagcctgggcgatagagcgagactctgtctcaaaaaaaaaaaaaaaaaaaaagagagatgtgaaaggatgaactctactagatcaaacctttgattttatgactttcttctcttgattgagtgacctgatgtgtagtgactggccctcaatccagggaacagaagtatatgtatttgtgtgtgtgtctgtctgtctgtctcacacttgggttacaaagtacaataatctagtaaaataattggaactgattgttcaaaccattcaaacctcctgtaaatcaggcctcttggttcctctccttctctccctcctgtgtctgttcatttggtcattttatttctgaatggtaattttcactgaggggtgggataggaaaataaaaagatatgaaagtcacattaggtagtgtagagaataattttaatagaagccacagtggagaatgcagatgtaattagcattaaaatgaaattctgaattgtcggtggattttagcttactttgctctccaaatcctttgttccctttaaaaactgagtacaattatgacaagcacctagcgaggctgtgcttcttttgtcctgctgaagaagccttgtctgaaccagggtggctgtgagcaggtcctgggccgagtaatggcatttaatgcatttgcctgttttagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaaggtacttctcattctcccacattctctaagtagcaagattagggagtctggttctgcagccaagactacggaaagcccaaagtctctctcaatttctaaaagaggtaacttcaggaactgtcatgtggaactgcttgatgtggcacctttcgtccgcccaagcccgaggactggtatcctctcacttctttgagtgtgggccctggatctaaaccgcccaggtccaaatcctgcctctatctcttcctagttgtgggaccttgaacaagatatctaaccacactgtactcgcttacctcaactgtaaaatgggatgatgttggtatcttccttgtggacgtgttttgaagatctaagaggtaatcttagttaagcagttagaacactggctggcccatagcaagagctccaaaaatgtcattgtcaccaccatcaccaccgtcattattgatgcttatcgattcacaggcattctttttcatgggacaaatgaacacacatcttatccagaaagtcacaggtcagcctttaaagaaagaactttatatctatgattttgtgaccctgagaatcctactgacataagatttttattagttggaaacatgagagattcttttgatctgcatcaaattatgtgctttgtatctccctaccagccccacattaggagctattctttccttttataagcagtacaaaaaaaataagattaagctgttctaagaattttcttttctatttttaaagccacgatgcagaagagaatagagaacactgataaatgtgcatgagtaatagctgaagagacaatttcccagtgagaataaaaagaaaaaggaaaaactacaatatgatttacttccagtaatcactaccacatttttactaagcatctattgtatattcaacatgtgctaggcattatgggggatacttataatgataatgatggctgtaatttattgagtatttaccatgtgcccggcactgtgctaagggccttgtcattatatgaattgaattcaatctcacagctaccctgagaagttgttattatacattggagaggaaaaggaactaagtttgagtactaagaatagaattaataataataataataataaacatttattgaggatatactccgtactaattgtttttcagcatttttacataattatgtcatttaatccagtgattctcaactggggtgagtttgccctgaggaacatttggcaatgtcttgagacatttggggttgtctcagctagaggggtgctaccggcttctagtgggtaaaagctaagcatgtgccaatgcacaggacaactcccgacaccaaagaattctccagtcccgaatgtcactagtactgagcttgagaaatcctaattgaatctttcccctaacttatgagttatatagccagcaagtagtggggcagggaatcatactactctaaactatctctaaactacctctcaagtatttaactactgctactctaaattacctctcaaggtagagtgaaaccccattataaagggcttgttatacagggctttaaaatctaggcaaggagtgtttgcttgatgttgcaggaaacaggaataaagatgagcaggcatgaggatgaccagaaaaaaacaaaaacaaaaacaaaaaaacctgtttaaggaggataccccatgtgacagcaggatggcttggagaggagggggcctacagtgaggaaggccagatacaagttggtgtcagtaatctgggtgaccaggtcctggatttggtgtagttgcaatggagagaaaatgatgggcacacacctacatatgcatgtgtgcacacaaacacacacacacacacacatcccagcagaacctagggtgagtgaaataagtagagaaaagaggcttattccaaggtttgggtctccccaagacccaaaataaataaaataaaagtgccattggaaggggtcactcgttttcaggaagatgaattaaattcaggacaggacaggacaagatgatttaaagtgacagcaagtggtaaaagagagggatgcagtgggaattaagcccacctggcctggtgccctggcagcccgctaaacatggcctggtgccccagcggcccactccagtctttaagccttgggtaaatctaacaaattttctagtttcagcaccttatgtcccaactgaagtagtaacatgtggcctgcccacctcacaaggtggttatgaggatcgaatgaggaaagagacaaattccttttcacagtataaaatgtgacctaagtgtgagtgcccattgccatcaatgggacaggaaatgaagatttgggttcctcatcataggagggatgataaaaattcaaagaattaatgagttctctcaaggagaaactttagatgcagaaggacagaagaccaagaaatcctactctctggggtaggacaagaaagagggaccagcaaaggagagaaaccaaaacatttattcttctagttcccattatctcatagaaatgaaaatagttggaaatacatttcagccaaggattcaggtctccactataaatgtaacatacaactgccttattttgaaaaggcattatgaagtcaccattccccccttcaaatctgcagacatgcacatccatcccagtggtgacatcactcttctctctcttcaacagattgactttgtggctcatgatgacattccgtattcctctgctggctctgatgatgtttacaagcacataaaggaagcaggtgaggcattcccctgtgctcacctgtcaaccacatcacaataatcaggtgcaataagagacatctgtctgccctgggacatctgcagtgtatacaaacagggagttacaactttaggtgtcccccaggcggcttctacaagccactgttagcatgtgctaaggctcagttatggcacagataccatttaggtatttatataggaatgaacctgagcaccaaagtgctcaacttcaggtctaaggcttaatttccggggtcatcagacgaaaagtgcaggaccccattacttaaatggcagccattttcctcattcataattaagtcttcacaatgagattattggatactcccaagaaatttccttccagaagcaggtagataactggctagttaataatctggactccttctgtccaaagttagtcctgccatatttctagtgtcatcttgtcacatgttagtaatattatcaggtaccatatgtggaggcaaaaaaaaatgggtaaatgttttaatggcttggcttattttctgctattttactatctaccatgcatctcatctataggcactgtaggtacacccatgcataccttcctacatacattaaaccataatctggcaggtgcagatactatagtgagttaccatatgcatagggatttcaagaagtctagtgctccctgcttatactagagccattgttgacatgtgccatcagagccatcttccccactcctggggaccaatgagactccactcagcttgctcccaccatttcccactcagcctgctgccactacagccttttcttggtactcatggaccttcagattcttgaggtaggatgggctcctaagggtcactgacccaggctcctatctccttcttggcatcattgccagctcctggcagaactgatgcttttacattccccatgatggagaactccctgccttgtgaggcagcccgttccatcttggatggttttggctgtcattgtttaatatatgaatcccctgagtgcatctataagccaggaattgtataagagaaaatgaataagacatagacctcacccttgagagagagcagagacagacataaataattacccaaaatataaccagcctgtggcagagtatatacaatacagcaggccagggcagcatgttcgaaggtgggactgtatgaagcacagcgtgtctggagaaaataaacatgttaatgtagtgtagggtgtgtggaggtgggaggcagagatggagactggcaggacaagctggttgaggcttgcttccatatgaagttacatggaaccaaatactgttctgaggcaggggagtgtcgtgatcaggtcttttgtgtgggaaggagcaactggggggccataagtggtttccataactaaacttaactaggaaaccccatttccacagctgacagaaaaaaaaaatacacttgacatgtgaaatcattcagactcttctaggtttgtacttagactgtgtagagtaaactttttgcctttttctcctgaggtgatctaagtttctggagcactctggcctggcatgggatggggatctttagttgtgaggtctcaagacctgcttagccatcagccccacttaccagacccctgtggcagcctctgagactctgtcatctccccactttggcctgagactgtcacctccccactttggcctgtcctggccacagcatctgccgcaggattcccttccctgtgctataggtgtgctgcccagcagtcatgctgatcttaaatcttggcttccttccatattcctctagagagtccccaggaaatttaaaaactgtcctccataatctactagagggcaagggaaaccaggcaatgtcagtaagccatgtcaggccctgtctgacctgcccgccatgttggcctctgtaaaactatttctttccaaaattcctggccataaacaaggtgccagtggccctgcactgagctttctaaaggggtctctttcctgcccctgcccctggtatttgaacctgagtcagagcaagggacagaccgcactcctgttctctcatttctgctgtccgcttcccaatccctctctgcactcctcccctcaactcccagaggtgcttttcttcttcctggagagcagaaaactgccccttaattaatttcatgccttcccagggttaatatacactccagggcttatagtcaaacattctgtaccctgagtctactcagcctctggttcttaatagttcaaaagacacttctgggatttataataccctttttatactcctcaaagcttggctcttcctagtggaattcttgcctttcttaactcttctttttaaatgagccttaaaaagagcctgttttagaagttgaaggctgaacacggcctcctgtactctcagcttcatctgcctccccctgaagtcatcgagttctcagtgtccatgggaacagggcctcaggacagacatgatccctagaaatgaaaacaacattggatactattttgaaaaattattgttacataaaatgtatgtattctccctgatggcatttttgttggttcacactccttgtgggccagcctgggaagctccatgccatcccctgcagggctggtggtggggactgtaccatcctcttaggaaggacttcctgagaagtcaagagcattggataatgggaggcctgacattctcaagtctcaatcttgtttgtgaggagttccaaggaaggaaacctcatacacttcggacttggaagtctgctctggaactggagaagaaactggcagatgcctcagttacatcaagatgggttacagcatggcgtgattaatatttatttatttacttactttacttacttaatttatgagacaagttctcactctttcacccaggctggagtacagtggtatgatcatagctcactgcaacctcgacctcctgggctcaggcgatcctcccacctcagcctctcaagtagctgggactacaggcacacaccaccatgcccagctaattttaaacttttttgtagagtttccctatgttgcccagactggtctcaaactcctgggctcaagtgatcctcccacctcggcctcccaaagtgctgggattatagctatgagccaccatgcctggcctgataaataccctttaaagtcattgtaagatctgaactatgagccagctgctcctttcctaaaattgccataaggatttgttatagaccagtgcttatgaaacttagatatgcctcagatcatctgtggaatcttgtgaaaattcagattcagattcagtaggtctggtggggccagagattcccatttctagtgagctctcaggttgttagatgctgtaggtccataggcctcacttacagtagcaaagatctggaccaggcattctcatccagctgagttatccccagggtttcttgaatcagtgtttcctgggggcagtagttccttggctaccttatagtgtataggaataagcatttggtggcagttttctttctgggtgagtggctgtcagtgagctaagaatatgttgctttcctgatttggggaataaaatgtcaagttccagttgtttaggtgtaggaacaagtccaacatttttctaactctagcaatccagcatccctattgttgcataagaaagtgactcctaaagttagtgacttaaaagagcctcttgatttcactcatgattttgtggggcaggattttagcagaggcttggctgggtagttcttgcttggggtctctcaaacagttgtaatcagatgttggtgggggctgtggtcatctgaaggctcgactgggctggggctcccaggtggtacacttacgtggctggccttggatgctggctatgatcatggcactcagttgcagttgccactggggcatacaggtggcctcttcatgttgcttgggcttctcacagcatggcagctgaaaggtaatatctagagagaaagcaatcttgacagaagccacaaggcttcttctgacttagtcgtggaagtcacacagagttacttttgccacgttcatttggtacaagcaagtcactgaggccagcccagattccaggggaagggaattgggccatctttaatgcaccacaatgccctttccaaattgaatagtcaggtagcattttacttgccctagtagcacaggctaagactcgatgtaacttttcctatgtgcaaggacccttccttgtgctccatcaaatctgctctgctgattccttagcaggagggagaatcacagtaatgatctatttgggacccaggtagagaaggccagaattcatcatgggagaaagatgctcagaaatggcctcagcatccatatttggctttcatactcaaatcatggcttattttgaaagtcaaaagtctctttaaatgaaaccagagatatcaagggcatgacttaagctttacaacactctgctctgcttgtcagaactatgtgtcaaaatcctctagcaaagctggatgaaaagatggagcttaaattaaatagactgtaaggtccacattactcatcaccattctaatattgcctactactgttgaaagtttccttcattaacatgtgctttgctgcttcttaaaatagctccataaccaaatgccgcaattctgaaaagcatgataaaaaaggttctctgatcatgctcattaccgaatatttttagcagagcaataattaggatttgaaggaagccgggtatctcattatgtcaacagaggacttggcttctttcagagacctacctcccaaccagccaaagcaaatctctccctaagccaaatctactttcagttactcaaacacagagacttcaccttctggcttcaaagaaagggtaagctcatggcatcaatgtcttacatgacttgctaaaatccattagtcactagagaatcgtcttattatttcagcaggaggggtgtgggtaaaatatctgcctgctgaaagatgggatggatttctcaccagaatgttccccactgttcccacaaaggtggggatgtcgtctgagggttcccccacccaccagagcctcctgcacagctgggtcaatttgggtgctatttatgttcgtgtgtttagatggttacatcttctgccttccatttggttttccgtgttagattcttccctcctagaaagtgataaaagaagtgtttggcctagtggcaaaccccaactgtcctctgaccatggaacataagaaactggatgttttgtctctaacatcagcagtgccactctgctactgatactataaatgtgcaaatgacatcaaaagaaagctccaaagagacaccctcattggggctgcaagatggaaacattcagagagaactgggtttggaagggcacttagagatcaatattcatctagtcattcattcaagaaatattcctatggtgcctgtttgtcacccagtgctgagaatgtagaagaggacgagaaaggcatgatcccttccctagtgtagcttatagtcaacaagacagttgttgaacaagttattttataaagatcttgctgtatttggagggaaggggagtggtccatgggaaggaacaacacaccagaagacctagtctgagggttgagatatttgcttgaggaagtgacactaaagctgaagcccagtggatgcccaggagttaaccaggtaaagattgtgtctgtggcagagtgaggggaggggaaccaaccctttcaggacactgaagaaacccagcatggctgggctgaggcagggtcagcctactgcacagctccacagaatacaacagcagtccccccctgcagttgtatagcaggggggccttggtttagggagtgaaagggagagggtctgagataaaattggagagaagcacagggaagagacatgcaagctactgcacagccaagttaaggatttgactctgaatccagagaagagcagaaagccagtggagggttttgagcagacctctgacttgcatttagtaagaatgctctgtagaacttgctctctgggttgaggcagacaaaaatgacattgctggagactggttttgaggttcttgctgtgatctttgaccaagatggtgttgaattggtttaggatggatgaaagtgagtgaattagggaaacatttaagaagtagattgggaacttggttggatgtgggaagtgagagagaaagaaatggcacagatgagtcccaggtcatcatgtccaatcacctttttctcagctgaggagactacagttaagtaactcgccttcagagggtttgagtgacttgcccacgtctacaaaccaagaacccagtgcccttgtccccaggctttgtccatactgtcccatgcctgatgcctctgactgagttgccgtaatgatatgggatagaaagatctcagttgccaacaacatgtcatttcagttcacaacagaagtgtaagcataaacctgattcttgcctttgttaatatttgtgacctctttatagctctatatctgttgatatacccacatttatctttgaagactttaaggaagttctattagaacttggcatcctctgtgcttgtttattttttactcagccccacatattctagatgaaagggcctttgagtggtgaaactaccatgtacagtagactgttcttaggaagataaatcatctaaccatccctacaggcatgcctttagatcagagacgacacaaatagtacactttttcttcttttcctttagtataatgtgagcagacttccttggagatgaagcagagttgctgtgatctaattcattgactcagttgttagtcttcatttactttctcactcaatttccatttattgagcaccttccatgtgctagacacaggggctgaggtgggtgctggggatgcaaagacagttaaggcactatcagtgctttcaaaatgttcattttctacatggagacaaatatttaattttttttgtttgtttgagacaaggtcaggctggagtgcagtggcgcagtcactgctcacagcagccttgatcttggactcaagtgatcctctcactttagtctccgaagtagctgggaccacaggcgtgcaccaccacacccagctaacttttgtattttttgtaaagacagggttttgccatgttgcccaggctgatctcgaactcctggactcaaatggtctgcctgcctcggccttcgaaagtactgggattataggcatgagccaccatggctggcccaatatttttgttaatgaaagataagttaggttctgaatgttgtggattctacctgatgacgtcagaaaagacttcccagaggcataaccttgaagctggactttgcaggatgaggaagagctttgcagttaatatgagcagggagggggtatccagggcagaaaggaaaggctcagcatggataaacagcaggggccaggcaagtacatggtatgtcctggaaacaggtctgggatgatgaacatgtagcatttaaggtagagaggaattccacggaactgagggtggaagagtcacttggggccagacgtaaagtcttcattggcatacccaggagctccaactttgtcctgtaaagggggaccattaaaggagatgggtcaactgaggtgatcttaatttttcctctatccgctcttttctacttgaacagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgtaagcatgccacctcaaaccctctgaagaccaccatgccacaccaccaccaccagtgctgctgtttattgagcacttactaagtgctatgcagtgttctccctctctctctctcttttttttttttttgtgtagagatggggtctcactgtgtataatattttaagtttgatttaacttgtttttttttttttgagacagggtctcactatgttgtccagactggtcttgaactcctgggctcaagcgatcctcctgcctcagcctcctgagtagctgggattacaggcatttgccaccatgcctgtgcagtgtccttaacgctttgtatttattttctcatttaacccacacaataacccatgatgtattattatccccattttacagatgacaaaaccagtatctacaggggtaacataaattaaccaaagaacacaggtagtgagcttcacattttataaaggtgcttccttgcttccctcctcttaccccaaactctctctttagagtttttagacttgattgaagggtttctgggagatctgccccttgtaaaaggcaagagttatcttctgctgaaaggaaagggaggagggaagaggcaatgaaagctaaacccagagaaacttttttattctaacgttttaaaattttcatttgattaaggccttacagatgctcattagaaaccttaatggccatttttcattgtccaaagaaattacagctgcttaaataaagcctaaagtctttggcttccttttgtagttctaccatattgttcccacaggactgctgttagtttaataatagagcaactgttaaaacaatatttcagttctggcatacatgtgcagaacatgcaggtttgttacataggtatacacgtgccatggtggtttgctgcacccatcaacccgtcatctacattaggtatttctcctaatgctatccctcccctagccccccaccccctgacaggccctggtgtgtgatgttcccctccctatgtccatgtgttctcattgttcagctcccacttatgagtgagaacacgcggtgtttggttttctgttcctgtgttagtttgctgagaatgatggtttccagcttcatccacgtccctgcaaaggacatgaactcatccttttttatgtatgcatagtattccatggtgtatatgtgccacattttctttatccagtctatcattgatgggcgtttgggttggttccaagtctttgctattgtgaatagtgctgcaacaaacatacatgtgcatgtgtctttatagtagacaaagaacattaacagtgacttagattccctcaggatgccatttttatataataataataataaaaacaatctttaaaataagcaaaacaagctgttaaaaagcaaagagggcagcccagttgctggagatgatgttagtgattctgagcaactgtatttgcctgggctgtgaggtgccgatatctttgattaaaataagaaccctccgtacatacagaattctaacccccaaaatagacgctgtattttcaaaggatgattcatcttcaaagctagatacttaaaattacatgcagctataattatccaatagctcacacaattgatcattggtaccttcaaaataggaggggctcattaattgtgaatcgttgatcatgagttgtcctcacaaggcagggagtgttgagagtctaggctctgtaacttcatataagccgggcaacaaaatgtcaggaaatgtcggaaaatgtcaggtttgagtggcactggaacaagtggctgaacataattcagtcaaagtgattatttagtatctgatagagaataaagccctggttatttcaataaattaaactgtctgttctttcaaattgaattcggtcaaccatccaaacatgtcaagccattttcaaaagttattgctcactctctttaaacggcgtttagataagccacttagctcaaggaaccgtgcaggcagttcggatgcactcactgccttcctgtgacgacaaacctggctgcagttcagagatgaaatctaatgtgttgcatgggcgtgtagacaaatcacggaacctcagaggtgacagggacctgatgccagtcagtcacccagtccaagtccctcaatttagagatgaggaacgctgagcccagaaagggagcctggccaaggtccttcaggtcagggagaggtagaggcagcagcaactccccagtctcatgactcccagcccagtgctcattcagctattctgtgctgccctgagagccatgtatagtaactatttccagtgcagaatgaactgtggaaaagaatgatataaaggcaacagctaacatttgccaagaactcatcatatgctcatctaagtgttttacttggattatctcatttaatcctcatgatgggcctacaagggtgggtaggatgactatgtccaacatagaaatgaggaaacagaggcccagagaggttgaacaactcacctaaggtcacctagtaagtaacggaagacagagtgacctcccatagcacatatatgtatatatatagctctcagtagcaacacacatagctcatgccccagcctgaggctgcaggaaggtttggaaggtcgaaatcaaggactctttacccagttttgcaatattccaggtgtttcaaaaacttccgaaacacaggccaggcacagtggctcatgcatgtaatcccagcactttggaaggccgaggcgagtggatcacttcaggtcaggagttcaagaccagcctggccaacatggtgaaaccccgtccctactaaaaatacaaaaaattagccggatgtggtggtgtgtgcctgttattccagctactcaggaggctgaggcatgagaatcgcttgaacccgggaggcagaggttgcagtgagctgagatcatgccattgcactccagcctgggcaacagagcgagactccatttcaaaaaaataaaattctgaaacacaaaatgaactttagtcccacatagtaaagaaaaatgataagccttacccctttaggagaaacatcatgatttcatgggggaagagccacatgttattttcatggttttaatactgctctcatcaggtaacacagacaaatgcctctgccacttaatactaatgaaacagccaacatacactgagcatttactaaatgctggcctttgtgccaagcactttgcatgcattgtcacagcaaccctaaggtagggatgattattatccccaatttacagatgagaagactgaggtttagaggtgatatgtgacttgcccagcatacgatggtttccaagcacataagtagacattgctgcagaaagactataagaagaacaaaatctgagtctagagaaactatcagcacaaaagctttcatcaccaccaaggaaatcaatacagttaaattagcatagtggaaaatattacagtggaaattttagtataacacataggttctaaggcccagttaatggcccacttatttcaagcaatattgttttaaccatatcccagtaaaacagcgaactcaggcagcttctgaatagtcattgtgtgcacaattcatacttttgtctaagtcccagcagaattgaatggggttatttgcccaatatctatgcacaacaaaagacaactgtgtgttttttattctcctcttatataagtgaatccaactcaaagacatttaaaagaaagaagatattaaaaccacttgtagttccctttacatatccaaatggattaatggcagatgacttttcttacaagagatgtgcctttccatcaacctagcccttgggaaatggcaacatcttgactcttcaggttaggaacaaatacaaattggaataaaatatgaactttaatgtgaatgattgatctctctcatgtcctcttggataaatctgtttttttttttcctgtaaactttcaccaggagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatgggtatgtaatgatttcactttaccccacaatgatgagtgttttcagtttatcctcctttttatggagccactcaagggtgccccttatctcagatccactgcatgccctctactttaggcatcagcctgaatgacttcaagtccatgtcacttccttactgagtttctgctttactcgtcaatatggcacccagtagcacacaaagccacgtctggtttcagtttctagttcttatccagagcttggaagccatctggtgatcacttgagtgtctcttacttcaggagttgatgctgtcgctcatctcagtctcccagttggggatgatgaaactttgggagtacagatgaagtgggctagtggcagcacggagcttgtgttacaagacatggatcatgggatcttggatcaactactggcatttatgttttggggaggagaatccaaagaaatgtactctgtcagtcagtttttcttgtgaggagccctcctcttttactggttgcaagacagagagagaagaagtaggagtttgccctgcatctgtgcccatcgtgccctgattttcccctggtttttcatgacacgcaagtgttgggataaggcacaacagtctttggggactgaggacatgatctgaatcttaaaactgagaggaaatgtagagggtctccttgcctaaaatctgaacaactttgaatgataactatggaaagggaaaagaaaattctggaaacctccactggtactttattggtatttctattgtgcatgcccttcccaagtaaataccagtattatcaggagagttgatgaggggtctgtaaaagagattcgaaaagtttactttagagacgctaaagggttgacgagggttgtatgaaagagatactaaaaacaaaatttcctcctacaacaaaaagaaaaaattccatttgatttctctgattttaagtagcctggatttcctattataatatgagaagtctctaccaaaatccactttgacttaattattttattgacgggttgtcactgctacctctgcttgtttgagctcattcattataggattatctaaaagtgaaacactcaattagtaatagaaaaagaacaatgtttgggaagttgggagagatgctttgcttaacacctggcagcctctaagtgattatagacgtgggtgttataggccaaccatgtcctatcggctgagtctgagaggggtgaaaggtttacaaggactgcatgagccttcaaagactcctagaaagagctggcaagagtggaggagccaagggctgggctccttttcattttccccaggcctgttaaaaatttcagctcagataagttaattcctggtacatttcttaatgtttttgtctatgcatggcactatgcataaagaagaacataaaaacagacaaagtacagaccctgttctctcgtctctatgacatatggtatgaaattttctatttaatctagtgtgtattttaatagttcacattttcacaactaatttccaggctctaaagaaacaactagtggtttttaatgaaaccatgtaggtgttcattcgtttacagggattcagaaacctgtctctgctgataagagttggtatagtaactcaagagggtggatgttttctccacttggagtgagtaaaggcagggaaaaaatgtaatttcccactttgggaggccgaagtggatggattacctgaggtcaggagtttgaggctagcctggccaacatggtgaaaccccgtatctactaaaaatacaaaaaaattagccaggtgtggtggcgcgtatctgtagtcccagctactcaggaggctgaggcaggagaattgcttgagcccaggaggcggaggttgcagtgagcccagatcatgccaccacactccagcctgggtgacagagagagactctgtctcaaaaatatatatatatatgtgtgtgtgtgtgtgtgtgtgtgtgtgtgtatgtgtgtgtatatgtgtgggtatatatgtgtgtgtatatgtgtgtatatctatgtgtgtgtatttctgtgtgtgaatatatgtgtgtgtatatgtatatatgtgtgtatgtgtgtgtatatgtgtgtatatatgtgtgtgtttgtatatatgtgtatatatatgtgtgtgtatgtgtgtatatgtgtgtgtgtgtatatatatatatatatataatttgatgaaaactttatagaccttagtcatttcaggctcccagtgaaggtgaaatagtagctggaattgttcttgggagtctgatgacagcaagccaaggtgatttttaagaaatgaaacccagtttagagactggaggtttttctttttaaaacttgctattagtgtcaaaactgttattaccattaatttaccatatcagccagactaagacattactttttttctgttgacgttaaaaatacaggaatagttacaaggatgttaaacgccaagataagtaatttgcttttcatgaatatgctattattataataattccttatttgtgaatttgggactggaactcatttcttaaaatagaagatctgtattaccggcaaatacagtactgttacaaacaacccaaacttggaaaggcacaaaatagaaggatttaagatacaagttctggtacaatgagataggtatgcagcatagtatgtaacttatagtgggtattccacaaatgtttctgggttaaatgaatgtatgaatgaatggatgtatgaagaagacctattcacagaaccttccagcatctgcaaaggatttgtgtgctaaagcctaaatcccccaccccatatacgtgtgtgtgtgtgtgtgtgtgtgcgcgcgcgtgtgtgtatgtagacagatagatagatgataagcagatagatagccttagccttttattgcttatggtgctaggtacaggactttattacaacttggtgtttggtggatcaaattcagtacacagacgtggtgtgctttgcccttaacaatgttttaaaatttattttagggaaggcatgagctcttgtttgccatagtcacaccttgctccgctgctcctttcccctcccctaacctgactcacacatttatgcagcccatctggccccagggaatatttgaatttgctccttgtggtatagtcttttttaaagcagggtctcactctgttgcccaggctggagtgcagtggcatgatcatgactcactgtaacctcaaatttctgggctcaagcaatcctcccacctcagcctcccagatagatgggactacaggtgtgtgccaccatgcccagctaatttttaaattttttgtagagatacagtcttactctgttgcccagactggagtgaagtggtgtgatcatgactcactgtaacctcgaactcctgggctcaagagaccctcttgccttggcccaccaaggtgctgggattacaggcatgagccactgggattacagtgcctggccatagtcttttaagtctccccaagtgacctcatatttgacattaaggatgccaatataaaattgaagcccttacatgctatctctgagtagaaagtagtgatgatgatgatgatgatgatgatgatagtaaataagaaggtgatgatgatgatattgtctaaaagttgtatggcaggttgaattcttttttcaatgtccttgcacatttattctacccattttatttacttatttatttttatttatttatttatttttgagatggagtctcactcactctgtcaccccaggtggaatgcaatggcgcgatctcggttcactgcaatctctgcctcccgggctcaagtgattctcctgcctcagcctcccgagtagctaggactacaggcatgtgctaccacgcccggctaatttttgtatttttagtagagacggggtttcaccatgttggccaggctggtctcaaactcctgacctcaagtgatccacccaccttggcctcccgccacccattttaatcacacaggaaggtacattttatagataaatatatagatatagacaaaggcctacaaaattatacgatgaaactttcccgtggtctcacaggagttggtaggcggtaggatggagcctggggctagcctctttctcctggtcatgtctgtatccttcaccataggaatgtccacatgatgcagtcattttgcttcattttcctttggtcggggtgtgtcactgtagagaaactgaggtctaccaacatccctctaaggcctttgacaatgccagttgccagaattgtgcttgagaccaggccatctagatttatgataggcactctcagccctccactgtactgctgtctctaggctttctcagcaaacagaaagtgtggtatccatgcctattagttagcttttggtggtaacaaattacctcaaaacttggtggcttaaaacgacaaacatttattatctcacagtctctgagggtcaggaaccaggaagcagcccagctggatggttctgactcggtctttcatgaagttgcagttaagacgtcagctggtggccaggcacagtagttcacgcctgtaatcccagtactttgggaggccgaagcaggtgaatcacctgaggtcaagagttcaagaccagcctggccaacgtggtgaaaccccatctttactaaaaatataaaaattagccaggcatggtggtacacggctgtaatcccagctactcgggaggctgaggcaggagaatcacttgaacccgggaggcggaggttgcaatgactcgagattgcaccactgcactccagcctggggaacaagagtgaaactccgcctcaaaaaacaaatttgtgacaaatatattcatatattcataaacataaaatgtaccattttaaccttttttttttttttttttctgagactgagccttgctcttgtctcccaggctggagtgcgatggtgtgatctcagctcactgcaacctccacctcccaggttcaaccgattctcctgtctcagcctcccgagtagctggaattacaggcgtgcgccaccaccatgcccagctaatttttatatttttagtagaggtggggttttgccatgttggccaggctggtctcgaactcctgacctcaggtgatctgcctgcctcagcctcccgaagtgctgggattacaggcatgagccactgtgcccggcccattttaaccattttaagtgcacaatttagtgggattaaatggttgcattcacattgtcctgcaaccatcaccaccatccatctccagaacttcttcatcatcccaaacagaaactgtaaccattaaacaagagctccctatccccttctgcccccagcccctggcagccagccttctacttcctgcctctataaatttgaccactctatgaacctcatatgagtggaatcatacagcatttgtccttttgtggctggcatatttcacttagcatgatgtcttcagggttcatccatgttgtagcatgtgtcagaattttctttcttttgaaggctgaatgatattccactttatgtgtacatcacatcttttttatccattgttccattgatggatgtttgggttgatgtgaacattggtgtttgagttctgctttcaattcttttgggtatatactgagaaatagaattgctggacaacatggtaattctatgtttaatttttttgaggagccgccttactgttttccatagtggccgcacagttttacatttccacgagcaatgcacagggatctaatttctccacatcctcaccaacacttgttattttctgtttctttgtttttttttttaaataatcgtcctaattttaggcactgctaatttttaagatttttgattttgagaaaagagctacaaaatatagtttgtggatctgcattagatttcccacctgagactttgacagtttaaaaaattttatctttttttaaaaaaagattgttgttgttgttgtttttaagacagagtcttgctctgtcacccaggctggagtgcaatggtgcaatctcggctcactgcaactttgcctcctgggttcaagtgattcttctgcttcagcctcctgagtagctgggactacaggcatatgccaccatgcccgactaatttttgtatttttagtagagatgggattttaccatgttggccaggctggtctcaaactcctgacctgacctcaagtgatccacccacctcggcctcccatagtgctggggttataggcatgagccactgcgcccggccccaaatttttatccttaaacaaaggtacaagtaaaatgtgaataaacatgaaaagtttcttattatgcaactggctaattacaagagaggtggtcatgagcagggggtcactctctgggtaggtgacttaaggcaagttcatttgcctctctgggacttagtcatagcatcagtaaatggggaaagtaagcatagctgccacatagggctgttgcgaggattacattggttcatacttcatttttaaaatctatattttttgagacagggtcttcctttgttgcccaggctagagtgtagtggcacaatcatgggtcactgcaaccttgaactcccaggctcaagcgatcttcccacctaggccctctccccactcaacctgagtacctgggactacaggtgcataccaccatgcccagctaagtttttcaaaattgtttgtagagatgggggtctcacactatgttgcccaggctgatctcgaactcctggactcaagcggtcctcccacttcagcctcccaaagtgttgggattataggcatgagccatcgcacccagactggctcacacttcaacgcccttagagcagtgcctggcacctgtgtcgggcaccgtgtaagggttagttgttattgatttggccagaactgaagcatgggcccttttctctccttgagtttcatcttgcttacccaagggccaaaccaaaccagatcgtaccaggaactttatcatttcttttcggcagataaaccagaatagatctgaaatactgaaacctttaaaggcatttgtcaagacatttattgccccactagatgttaagtacttctggtttttgtttgtttgtttttgtttttttgagatggagtctcgctctgttgcccaggctggagtgcaatggcatgatctcgcctcactgcaacctccgcctcctgggttcaagtgattctcctgcctcagcctcctgagtagctaggattacagacacccgccaccatgcccaggtaatttttgtatttttagtagagacagggtttcaccatgttagccaggttgctctcgaactcttgaactcatgatccgcccgcctcagcctcctaaagtgctggaataacaggcatgagccaccgcacccggccgatgttaagtacttcttaaaagggaaaacttcataggagagaaatagaaaactactttcgtatggacaggactataaatgggattattttcttgagggaaaacattataaatggaaacctcttaatacagtgagagactgaatttaaatacctttactcttggaaaatgccatgcatactcttccttatttgttatatttctaaagtgcttttcttcccaggaagctcattacaaactgtctcctgactgtattgaattccgctcctttgcaagggaaccacccttcaaaatgcaccagaaacagatcagagagctggcaaattgaggctgggagttattttgcatggatattgcattttatgaagtgcgacaccgttgtttatcattaaagattcaagttctttcatcccctcaggcagaatgttctcagctatgagcttgattcaaactatagtagacaagtcgtagatttcttagaaagtgaacttctaatggaaatcctgacaatccattaacagcaggagggctaatggctgccacagaaaatatacttaaagattacagtaataaaaacacatattttaaagtgcctgctagaagttcaagaatgtttttaaatgttgctgttaataatagaccaccaaatccttatagcatttgaatttgcctcataaatgggtttaatctaagggagtgctgttgtactgcaccttttttttctgtttgactttgaggggggcttgatatcttttggcagaattatcaatgccttaatggaaggtaaataattggtatattagcagacgtgtggaattttaaatctggaaaagacctgagcaatcagccatcatctgttattatatctgctagaggaaacttgggactctacaaagtaacgggctagagcttagaaaggaaaaatgagtgttgggggcaggcagtgctattggtgatgcgcctgtggccttaatagttccttaccaatgtcattattgtaacacctgcccttccgcctgatctccttgcatgggttacatgagttctttcttcctactgtgatgcttttttatgataaaagtaatatatattcattatataaccattagaaagtaaagaagggactgaaaatcactcgcagtctcatcatccagagcagtctctctgttagcatttcgggttatcactcccatctgtttcccatctccgtatatgtacattccttctacaaacttgagatcatgcagaacatagtgttctaaaatcattttggctttgcagttgctcatgagtgttttctcacatgatgaaatattatttaagaacctgattctcctcatctgcttattatatcatcttggagttgtacaggtttttctaacctagttagagaatttgcagtgttgtgtgttatacattgcattgaatgtccatcatacacaataaagatttacttacatctctgattatctcctcagaaaatagaagtttttgcatctattgccaaattccccatcagaaaggcattgctgttttatcctcttaccagcagtaacatgaaggtagcccttttcctgagccctcactagctgtaacaaatttttaaaactttagcaatctgatatataaaatgtatcttatttcagccatttgcatttgttcgactactagtgatgctgaacagtttttctagctcatttacaaatttctcttgtgacttgtctatacaggccatatgttcatttttctactaagcttttcaccttcttctttttgatttataagctctgtctatataccgagatctatcatttgtaggtaaactttgcaaaaaattccactattttttgccttttttcttatttcatggtgttttttttttttttgaggtacagaagttttaaaattttgtgtagtcaaatgtcaatgttttcctttatggtttctttctttgcttttatgctgacacccaaaggtatttctaaaacacagatctgatcagactccgcccttgattaaaatctttctgggtttcttgagtaggaaatccagtctccttgtggtgctctaggtccagaccattgccaccccatgggcatttggggttctggccacactaagcaacttagacttagtactccttacttagcatgctctgtttagaaaggccatcctctactagcccccatggacccactccccatctccacccacctcttcctgggcattatcaaagacccagctgagacatgaccacctcttctaccctcttcttcccccccttcctcctgtgtagcacctggtccccagaagatctctgtaacggtttgtaaaatgaataacccaaaggacaagcaaagcctaagatggtaaataggagaattggctttcagggccagttttgtatcaaaggattgaactgagtggctgggggctaaggctcaaatgtgagcaattgaaagaccccaggcagcacaggcaggatgctcaggagttggtgggatgcagcgtctgggaggctgagcagcaggcagcaggcacagtaggctgggagcactgggggcccagtggggagcttcagggaagggctcaattctgaaagcacccagcaaccatcacatgaggtcccaaactggtaaactgatcttaaccaccgaaacctcctcccaccccacagtcttccccaaactgggaaatggcatcactgctttccaatttcttggacccgagactgcagtcacttgattcccgttcctcccacaccccatgtcccatctgtcagtgagtcccgttggctctaccatgaaaacatagccagaccacatactgtaggattctattttgatgacattctagaaaaggcacaactgtagggacagaaaacacatctgttgccagtggctgggggaggggagactccaaagggtcatgagggaatttgggagctgatgggaccctcctatgccttgattgcagtggtggtcactcaactgtatgcattgtcaaaactcacagaactggccgggcgcggtggctcacacctgtaatcccagcactttgggaggccaaagtgggcggatcacgaggtcaggagatcgagaccagcctggctaacacggtgaaaccccgtctctactaaaaatacaaaaaattagccaggccgggtggcgggcgcctgtagtcccagctactggggaggctgaggcaggagaatggcgtgaacccgggaggcggagcttgcagtgaaccgagatcgcgccactgcactccagcaagactctgtcaaaaaaaaacaaaaaacaaaaaaacaaaaaaacaaaacaaaacaaaaacttaacagaactgtacactaaaaagggtgagtttattatacctcagtaaaaatatgggggaaaatatactaggaatcctgccatttttcagcacactgccatcatcccgggccgggccaggctccatcaccatcttggatttttttttttttctcttgagacggagtctcactctgttgcccaggctggagtacagtggcgccatctcggctcactgcaacctccaccttctgggttcaagtggttctcctgcgtcagcctccccagaagcttggattacaggtgcccaccaccctgcccagctaattttttgtattttagtagagaaagggtttcaccatgttggccaggatggtctcgatctcctgacctcaaatgatctgcccgacttggccttcaaaagtgctgggattgcaggcataagccaccgcgcctggccttggattcttattgcaacgggctcataagtgggctccctgttcctgcccccgcctcactgccatctgttcccaacacagcagtcagaatggtcttttgaaaacaagcagcagattgttaatcctttgctcagaattctccagaggtttctcttctcagaggagactgtacgtgaaactgccgcctgatatgtctctggcctgatctcccgcagtgcctccccctctcccttccccaccagctcgctccatactgccacgatggcctcctcctctcctgggacctgttgcatgggtcccctcagactgaaaggcagagttctcacaatggctgccaaggccctccatggcacagccctctgtgccttctctggcaacctcttcccaaccgcctccctcagctcctccccatctatcagccctcaaggcagccgcggtgccctgcctgcgcttcctgggtgtgcgttccatgctcctttcttggggtgctctgtctggagtgcgctgccctctgatttccattcacctggtccctccccttatctcttccaggttcttcactcaagaagcgttttctcagtggggccttccccgagcaccctgtttgcaatcgcagctgccctgctcccagccccacttgctatcctctcgccctctttttctcacagaccacagatccatctgacataccatattttgtttattgtgtgattcctcctcatatctgtgagggtatgaggtcaggggttttgttttctgccacccctccagtccgtaggtcatgactacttgcctggctagtcagagacactcagttaaattttgtagatggaagaaaaaaaaggaagaaggaaagagtgttaagaaccagtggtagctgggcatggtggctcacgcctgtaatcccagcactttaggaggctgaggtgggtggatcacctgaggtcaggagttcaagaccagcctgaccaacatggtgaaaccccgtttctactaaaaatacaaaattagccgggcatggtggcgggcacctgtaatcccagctacttgggaggctgaggcaggagaattgcttgaacctgggaggctgaggttgcagtgagccaagatcatgccactgcactccagcttgggtgacagagcgagactctgtctcaaaaaaaaaaaaaaagagaaaaaaagaaccagtggtgactgtaatcttctgtcactacccctgaatatcactcggttccttactatacatagtcttggacaacacgggatgtggtatgagtgtaggtttgtgggctcaggagttttggggtagtggctctcctgcctgccttacctttttgttttgctgctgcctcagattgcaaagttaacagatgccttctctccaatttatctttagaagcagatgttccaggagaggagcagccggatgctgcaggccttatccccgaagcagagccctgtgagcagcccaacccggagccggtccccttcccgctcccc

SEQ ID NO: 4447 - DNA, 12254 bp, human; identical to SEQ ID NO: 3308

SEQ ID NO: 4448 - DNA, 690 bp, human; identical to SEQ ID NO: 3309

SEQ ID NO: 4449 - DNA, 2814 bp, human
gtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggtaagggtactggccttaggcgccggcttttcccagctcacaaaagcatcgggcagtgcctatctaggggcgcgggcagtaacgagttttcagtgatcaggagagtgtcggggcaaaggtgaagaaatcgtgactaactcagcagagttggggtggggagctccaggaaccacttctgctgggtgggctgctatcagaaactcagccaagaggaggggagttgtttgtttaggtttgtacttggctctctacacatttcttaccatagaaaagtttgtgccttcatgggaaatggttattctttcttctttagctttcttttaagtccagagcatatctttttctaaaaaaagtttttgctcactgaagattctgcaacatcgatttctgaaaccccattctgaaatttactagaaccttttttggggggaggaaatctattaaggctagcaaaaaaggaaacatttgttaaagggtcccatagagagactattccctagggacacacaagacactagatgtagtgtttcatgggcctgcctctgaatggttatttgtatggtcctaagcatctggactatcccttcctccaaatctctgtgaataatatcaggttggcaaagggatagggaaaaaagacacattagggactgagagcaggagcactgtattttagaattcaaagagactttagagacctgctaatcaaccccctttgctctgtagcctccccccaccccattttactgagtaggtagatgtgtcccaaggtcccaagtaaatggttggtgtgttgtggcacctgagggtcctgtcttctgggcccagtgggatattggctgcactaaactttcaggttgtctgttgggtgctggacacactgtcccacagagtgcaaccaaatcactggaggaacgtctccctggacagccaggcaccttgtcttgggtgtttctcactattagaatcatcttcaaccagcgtcctttcaaaatgattgaagtgggaacaaaattttccaggcaacttgagttgggatagtttttataatgctccttttgtatcttttttccctggtgctggaatctctgattaagtccctgccccctgcctagcatttttgagggtgcatagatcagtatttggtgggataataatttgttcaaacctcacgtttcatgacgtagagacctcagctcaccccagtgtctattatatgttacctttttgcttataccattgttttccaaacttgcctgtgcataagaagtacttgtgtgtgtgtggttgggggtgggagggagtagataaaagtctttctaggctcctgccttatatattctgattcagtagctctggcccagggtctgcaaatctgcattcataataagtgtcgcagatgattcttaagattatttggaaaacagtcttcttattccttcagccagtgttactaatcatccactatgttcctcgtcctgttgggatataaaggtgagaggggctcagcttccagaaatttacattccattagtttcagtatcaacagtttcccttgactctgttttatatacttttaacacacacacacacacacacacacacacacacacacacattcttccttattcttgattgacttttcctaatcctctctcaatatgagtttaaccagctaagctgagtgtgtttgaaacacaaatgtacctatatttgggagaaaggtaatgcctattaagagtgtggcctctctttgctgtttatcctttgtatgtcccatatataaatttaaatacattatatatataggttcaaacttaaggagatataaaactgtggagtccatttgcattttctcttccctgaccttattttgaaggccagtttgtgtgtctctgtgtgggggggaaccacttgggtggggagaaggtggaggggtatattgtgaacacagagaaaagtaatgtggcatacacaagatgaagttttcacaagccatgaatctagacctagagaagcttcagatttctggtggagtttcatgcaagcctcttcctactttcatcgatggaattcaaacacaacaaaattgggtcttaagcctggatctcaagctgtagatagaaggggatgataatgtgtggactagagtaatcagaactggaatatggattaaaatggttgctttatttttgttcttatttatgagatttgatattcgcccataataggagtgcctctcgcttattaccattattatttttttaaagaacactggttctgctgctctgtgatgattggcatggtgcttttaaaatacttttctgttgaattttttaggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaa

SEQ ID NO: 4450 - DNA, 3557 bp, human
cgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggtaagggtactggccttaggcgccggcttttcccagctcacaaaagcatcgggcagtgcctatctaggggcgcgggcagtaacgagttttcagtgatcaggagagtgtcggggcaaaggtgaagaaatcgtgactaactcagcagagttggggtggggagctccaggaaccacttctgctgggtgggctgctatcagaaactcagccaagaggaggggagttgtttgtttaggtttgtacttggctctctacacatttcttaccatagaaaagtttgtgccttcatgggaaatggttattctttcttctttagctttcttttaagtccagagcatatctttttctaaaaaaagtttttgctcactgaagattctgcaacatcgatttctgaaaccccattctgaaatttactagaaccttttttggggggaggaaatctattaaggctagcaaaaaaggaaacatttgttaaagggtcccatagagagactattccctagggacacacaagacactagatgtagtgtttcatgggcctgcctctgaatggttatttgtatggtcctaagcatctggactatcccttcctccaaatctctgtgaataatatcaggttggcaaagggatagggaaaaaagacacattagggactgagagcaggagcactgtattttagaattcaaagagactttagagacctgctaatcaaccccctttgctctgtagcctccccccaccccattttactgagtaggtagatgtgtcccaaggtcccaagtaaatggttggtgtgttgtggcacctgagggtcctgtcttctgggcccagtgggatattggctgcactaaactttcaggttgtctgttgggtgctggacacactgtcccacagagtgcaaccaaatcactggaggaacgtctccctggacagccaggcaccttgtcttgggtgtttctcactattagaatcatcttcaaccagcgtcctttcaaaatgattgaagtgggaacaaaattttccaggcaacttgagttgggatagtttttataatgctccttttgtatcttttttccctggtgctggaatctctgattaagtccctgccccctgcctagcatttttgagggtgcatagatcagtatttggtgggataataatttgttcaaacctcacgtttcatgacgtagagacctcagctcaccccagtgtctattatatgttacctttttgcttataccattgttttccaaacttgcctgtgcataagaagtacttgtgtgtgtgtggttgggggtgggagggagtagataaaagtctttctaggctcctgccttatatattctgattcagtagctctggcccagggtctgcaaatctgcattcataataagtgtcgcagatgattcttaagattatttggaaaacagtcttcttattccttcagccagtgttactaatcatccactatgttcctcgtcctgttgggatataaaggtgagaggggctcagcttccagaaatttacattccattagtttcagtatcaacagtttcccttgactctgttttatatacttttaacacacacacacacacacacacacacacacacacacacattcttccttattcttgattgacttttcctaatcctctctcaatatgagtttaaccagctaagctgagtgtgtttgaaacacaaatgtacctatatttgggagaaaggtaatgcctattaagagtgtggcctctctttgctgtttatcctttgtatgtcccatatataaatttaaatacattatatatataggttcaaacttaaggagatataaaactgtggagtccatttgcattttctcttccctgaccttattttgaaggccagtttgtgtgtctctgtgtgggggggaaccacttgggtggggagaaggtggaggggtatattgtgaacacagagaaaagtaatgtggcatacacaagatgaagttttcacaagccatgaatctagacctagagaagcttcagatttctggtggagtttcatgcaagcctcttcctactttcatcgatggaattcaaacacaacaaaattgggtcttaagcctggatctcaagctgtagatagaaggggatgataatgtgtggactagagtaatcagaactggaatatggattaaaatggttgctttatttttgttcttatttatgagatttgatattcgcccataataggagtgcctctcgcttattaccattattatttttttaaagaacactggttctgctgctctgtgatgattggcatggtgcttttaaaatacttttctgttgaattttttaggaaaagggaaggaaaatgattgcaatcatcatta

SEQ ID NO: 4451 - DNA, 5392 bp, human
gagctcccacgctgctgttcttccatttccagcttttaaagagcacccgccccttcgaaccaccgaggtcatgggcgaacacaccggagcgcagcaccgcgcccccccgcacacaccgcccgcctccgcgcccttgcccagaccgaggcggccgacgcgcctgcgtgcgcgctaggtataaataggtcccaggaggcagccactgggcagaactgggctacgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggtaagggtactggccttaggcgccggcttttcccagctcacaaaagcatcgggcagtgcctatctaggggcgcgggcagtaacgagttttcagtgatcaggagagtgtcggggcaaaggtgaagaaatcgtgactaactcagcagagttggggtggggagctccaggaaccacttctgctgggtgggctgctatcagaaactcagccaagaggaggggagttgtttgtttaggtttgtacttggctctctacacatttcttaccatagaaaagtttgtgccttcatgggaaatggttattctttcttctttagctttcttttaagtccagagcatatctttttctaaaaaaagtttttgctcactgaagattctgcaacatcgatttctgaaaccccattctgaaatttactagaaccttttttggggggaggaaatctattaaggctagcaaaaaaggaaacatttgttaaagggtcccatagagagactattccctagggacacacaagacactagatgtagtgtttcatgggcctgcctctgaatggttatttgtatggtcctaagcatctggactatcccttcctccaaatctctgtgaataatatcaggttggcaaagggatagggaaaaaagacacattagggactgagagcaggagcactgtattttagaattcaaagagactttagagacctgctaatcaaccccctttgctctgtagcctccccccaccccattttactgagtaggtagatgtgtcccaaggtcccaagtaaatggttggtgtgttgtggcacctgagggtcctgtcttctgggcccagtgggatattggctgcactaaactttcaggttgtctgttgggtgctggacacactgtcccacagagtgcaaccaaatcactggaggaacgtctccctggacagccaggcaccttgtcttgggtgtttctcactattagaatcatcttcaaccagcgtcctttcaaaatgattgaagtgggaacaaaattttccaggcaacttgagttgggatagtttttataatgctccttttgtatcttttttccctggtgctggaatctctgattaagtccctgccccctgcctagcatttttgagggtgcatagatcagtatttggtgggataataatttgttcaaacctcacgtttcatgacgtagagacctcagctcaccccagtgtctattatatgttacctttttgcttataccattgttttccaaacttgcctgtgcataagaagtacttgtgtgtgtgtggttgggggtgggagggagtagataaaagtctttctaggctcctgccttatatattctgattcagtagctctggcccagggtctgcaaatctgcattcataataagtgtcgcagatgattcttaagattatttggaaaacagtcttcttattccttcagccagtgttactaatcatccactatgttcctcgtcctgttgggatataaaggtgagaggggctcagcttccagaaatttacattccattagtttcagtatcaacagtttcccttgactctgttttatatacttttaacacacacacacacacacacacacacacacacacacacattcttccttattcttgattgacttttcctaatcctctctcaatatgagtttaaccagctaagctgagtgtgtttgaaacacaaatgtacctatatttgggagaaaggtaatgcctattaagagtgtggcctctctttgctgtttatcctttgtatgtcccatatataaatttaaatacattatatatataggttcaaacttaaggagatataaaactgtggagtccatttgcattttctcttccctgaccttattttgaaggccagtttgtgtgtctctgtgtgggggggaaccacttgggtggggagaaggtggaggggtatattgtgaacacagagaaaagtaatgtggcatacacaagatgaagttttcacaagccatgaatctagacctagagaagcttcagatttctggtggagtttcatgcaagcctcttcctactttcatcgatggaattcaaacacaacaaaattgggtcttaagcctggatctcaagctgtagatagaaggggatgataatgtgtggactagagtaatcagaactggaatatggattaaaatggttgctttatttttgttcttatttatgagatttgatattcgcccataataggagtgcctctcgcttattaccattattatttttttaaagaacactggttctgctgctctgtgatgattggcatggtgcttttaaaatacttttctgttgaattttttaggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaaactttcctgcatttatttctttcacttttacttcggtatcacactatactgcaaaaggtcatgtgttttctattacaaaagttattcttgaatcatggtacaattcgtgatgttttcatgtttactttttaaacttttaatgactataagaattttcaaaaacttcttactttaatatttttgaaaagagcctttttgaacactcattagaatcattcttttatttttttcaaaatcttccccaatacagaaatcatggtgcaatgagctaagtggccagtgttagctttcaaattattcgggcctctagactaatattggcctgcaggcaaataggtaaaatgaaactgtgcgtcaaagtttgtggctgtgaagtttaccaccattggctgaacgatcagtgtaatgatggaaagttcaaagaagaatggtaaaaacatttgtctcatggcaacacttcttgtttatcatggcttgtttctcataggtaaagtgcccacctcttgaaatatcatgaacttcttcatatttgcatagaaagtgaactggagtgatgattcattaaaccgtattctactgtcatattaaattgtgtgcgtttgttggctcatggccagtgtatttgcaaacgtgtgcatagaaacatagtaaatattaagtaagatcacatgatgtttcattcttggacacgttgcttctgaaaacgtagactggtttggccttttacccttttaaccgggaagctttgggtcttgtttaattgggatgaaacagaaatggctatttttaaaaagctagcaaaggactctgtggtgagctgttttataacaaagagatttttctccctccagacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattccagacagtcacaaatttctctgttccatagttaaagaagacatttgccaacaggtagcatagctctgtacatcttttaaaaaaaaaatagcagggtactagtataataagctattttcacaagtgtagcaatttcatggaacctgctcaaatcaaatttgtacatattgttataataaattttaaggtcttaactattaacttgattgaaaaaagct

SEQ ID NO: 4452 - DNA, 144747 bp, human
cacatgaccattggctggagcccagttgaccaagaaggaagccagagaaagccacacattcgggcgagcaaggtagttctctgtgtgatctgatgctacggtcagaacctcagagtccaagtacaacattcctactggttaggtatggggcatttttcttgtctggactgtttccctgatgtctgctaagcttgctctgtgtctgtggccagctgttggctcagccaggcatagatgggataggatggtctcactcatatgtctcgcaaatagctcggtgtcagctggggcaatgtggatgactttgccacacgtgtgtctcttgtcctccaacaggctagttcaggctcattcacatggtggtcctagggttttaagcgcaacaagacagcgaggcctagtgtcatgagcggtgcaaggttagagataaccagctctgtgcatctttgtgtctttccacaatgtcagactttcgttgatgctatctcaaccacaaaagccacatgctacatggagtttcccgggagacaattttccttagtacttgccattcactcagtagtcggagctgcgaatacacaggctcaagccactccacaagtcagtcaatattgcaaagcatactttcaatatcaaagtgttacagattaaacattccacaacaaacaaagaaacatttaacaccgagagaaaaagagataggagaaagggctaatgaaccactccagggggagcaaagaagacaaaaggaaacttgatctgggctgggtgttccttcggtcttgcaaggtagagcctttaatgtggcagtgccttcagtggcagatgtcaagcttttattacgagtgactgcaaggcagtgtcacttaagacggccattttgagctgctgagaacctgctctttcatggccacagagtcctctggtgagaagtgatagtggaagagcatgtttgtttgtgttcttatctggttggatacagtcttaatttttttatttgtttgttaggcaaaacatctttgttggcaaggtgccctatgaaatgtaaaatggagtctttttctaagatggagttagttatgtcaagggtgctctatacatctagtacatgggcttttgagcctctgcttgggttgaattagctgtgtgccactttgggaggcagtccaaagcaaagcacctgaaaagaagagataaagaacatgctgagaggggaaagatccacctgaatcatacttgtctggagagagaatggggggcggacaggaggctcatttcctgaggagtggactagagagggcagacctagggaggggttctcctctgacctccgctccatccttcctccattcatcagctcaggtgtgtcaaggtgactttgaagtcccactttctggaaaagtgagcagtgtattttaaaaattagatgattatatacaaaaaacttcattttaaaagagtagctttaatatttggaggtaattccaagcatatagaagaattgcgaggatatgcataggatcagcaggcccttttttgtttgtttgtttttgagatggtgttttgctcttgtttcccaggctgaagtgcagtggtgccatctcggctcactgcaacctccgccttctgggttcaagcgattctcctgcctcagcctcccgagtagctgggattacaggcgcccaccagcacgccaggctaattttttgtatttttagtagagatggggtttcgccatgttgagcaggctgggatcagcagagcctttatccagagtcacctatcgttcacattttaccccatttgctttgtcatttgttctctctctctcttatatacatacatatatagacacacatacatatatatatacatgtgtgtgtatataatatatacatatatgtgtatatacgcatatatgtatatataatatatacatatatgcgtatatacacatatgtgtgtatatataatatatattatataactatataatatatatattatatattgtgtatatatattataaaattatataatatatattatatattgtgtgtgtatatatatatatataactgagccatttgagaggaaattgcatatatgaaggctctgtacctgaaatacttaagcatatgttttctaagtataaggatattctcagtgcggtaccgtggctcacgcctgtaatcccaacactttgggaggccgaggctggcagatcacttgaggtccagagttcgagagcagcttggccaacatgtcaaaaccccatctctactaaaaatacaaaaataaaaaaagttggtgggcttggtggtgtatgcctgtaatcccagctgctcgggaggctgaggcaggagaattgcttgaacccgggaggtggaggttgcagtgagccgagacggcgccactgcactccagcctgggcgacaaggcgagactccatctcaaaaaaaaaaaaaaaaagaaagaaagaaaaaaaagtgtaaggattttttcaaagagagtacctttaaattcagagaacacacattaaagaggagcccctctgctgaggcataggaactccagaactgtacagcacagtgctcagctgagcaaagccctctcccatatgctctgccttattctctccggccacagtagcctccctctatctccttctacgagcgcaacctagtgggtagagggaagagagaagcaagcaatagaaagtcagggagagacaggacttttagcctcaagagaaatgaggaaggagtgagatattactgcttccaggaaattaaacaatgtgggggtgggaaagagatcacataaaattggattcttttgttcgtttctttcaaacagggaaaggaagaaaaaaagcattagaatgaaaagggacgcatggggcttttggaagatgtggcagagacacgccaaaaacactcattctttacttgcttaatttgttcaagactgattttcagggaaatgttgggacgtctgaaaaaccagaggcatctcagtggtacacattggaaccatatgtctcttctagaaacattccaggatcattttcctcgtactgaaccaactagacgcacaaagtaagaaaagcatgcgccactccaaggttcttaactgaggcttgctggcctctagtggccaggaaggaacctcacagctactggctccatctggctttaatgtggcttcagtgagaatgcagaggcttgggtgagggagaagagtttatgctaagtgtcttagttaaccattttagctaaccattttaaagtctgcttgagaatactggtgactctctgcctctgtaccaaaacctggataagaaattttcttgggtccagaacaaattacagaggcagcatttaagccccaactcaactccctttgtttctaagatgtggatgatgttctaaagataatacttttcagctctctaatgaaaagtacaaaaatagatgacaggcatgatatatttggagaagaatctcacgagcatctgagaatgaaaatcaaatagaaataatgtgtgccaaaaaagtttgtaaactctaaaatacacacatactgcatacattatttttaggaaaaaaaaatcagtgatcacgtggcctctataataggttcttggacaacatttgaaacttctctaagttcttatatacaggtttgcatcttttataaggttcttatatacaggttgctcctctttatatagaaataatggtacatcccatgtgcatggattgttgaaattgcatgggtcaacagtgtttaccttttattgtgcaggactaacacttattaaagatttaataaatttagctattattattgttgttattattttggacattcagtcccatgttcggttttatgacagaccaggagaaactttgcctaaattaggattctatttcacagttcctaagaggcttttaagtacatgtcgaccccatttaattaaggaatcacctgaaattcttcataaagtgctcctcaggtaggtagagcaatagcccttctaaggagaaaaatgcattcaaatagccacttgatatgaagacactgtggacaggatctaagtggcgtttggggaggttgacaagatggactttaaaacccttgcaggcttggaattctgtgtcatgtgactctatgacctttttttattgcctgcaaattcatgaaaagaggtaaactgcagcagactccagcgacacatcacagcacgaagtcagggttaaccttatgccccacactggaaggatctccatccttttctcctcggaaagaggcactctagtctctcctattcacacagggatgctcttcggatggcatggaggctgctcatgactgcagcctccctcctggtgccatcctcactcctacagttatgttagagaaggaggcatgtgtgttgaaaatgccttctaagtaaagaaaagattggcatcaagctgaagtaaatcaaagcactaagactttgtacgactgacggaaaatctaaaatggacctaagtaaagaattgatagtgggccaggcacagtggctaacacctgtaatcccagcattttgggaggctgaggtgggaggatctcttgagcccaggagtttgaggccagcctgggtagcatagcaagaccccatctctacaaaatatttaaaaattagacaagtgtgctttctgatgcctgtaatctcagctactctgtaatcccaactacttgggagcctgaggcaggaggatagcttgagcccagaaggttgagactgcagtgagttttgattatgccactgcactcctgcctgggggacagagacagaccctgtctcaaaacaaaacaaaacaacaaaaaagaattaagaattgatcataaaaactggcaaggatgatttatatgtcaatctgatattctgcaagatataaataatgcaaattctttgtattttggtagaaaataatgcaaataatatcacataatttgtcaattctatctgataggaatagagttagtagaactctgtgattcgtatgcataggaagaaacatatgtgcatattatcagaacatagaatccaaatatagttaattcttctttatggaagggtacaataacaagttggtgaattaactgcagtaaataataacagattataaatttctaagaagacaccatcattataaatcagcaatagtttgatatataagacatatatagtttgaaattaaatgaaaaaaatacaatataagaatagctcatgtttgttgagcacttcctgaacagcagatgctatgcaaagtgatttttatgcgtcatcttatttaatccttgagacagatcttgtgttatcctattgtaccaatgaggacactgggattctgtatgttagtggttctgtgtggtcaggaaaaaatgtttcacatgacaattggggatctagggggctctttgctctatgtacttttaagattgggaggcaaagagggaggaataaagggacggggatatttcagagcaaagtttgggacttagctctaaagactgtgagactcgaatctcccaaatctattctaagatctttcaacacgaccctggattcacaaagcacttactcaacagaagagaaaccctgaggagtatggaaaaaaagagatctgagggaggtaaacataagaagatgtggatttacctgaagatggggagtttactttcttttttttttttttttttaagacagagtcttgctctgtcagccaggttggagtgcagtgtggtgatctcagctcactgcaacctctgcctcccaggttcaagcaattctcctatctcagcctcctgagtagctgggattacaggcacatgccaccacacccggttaatttttatatttttagtagagatgggggtttcatcatattggccaagctggtctcgaactcctgacctcaggtgatccacctgccttggcctcccaaagtgctggtattacaggcgtgagccacagctcctggccagggagtttactttcttgagtggctcgatggatgcgggtgccaaccagggttgaggccatgaggaacaacgtcatgactcaggtcagcagtgaagaggagccgttggccagaacaagcaggtttcccatggcacccaaaactcataaagccttctgagtccattgcatgtgtgagatgtatctatgggcataggtggttgtagcctttttgctgtacatgaaattgtggatacctgccctgctctcatatttctttaagtttgggtttatgtctgcagggtgcttaatatgttactagatattggttgtgattgctcctgcatcctgttttaatgaggattgggggtgttcagggctccctcctccatttctatggttaatagagtgctgattctatagcacagggagagctcatatggattctgagaaccacaggttgagcgaaaaccttataggcaatcgcctgttttccagatgaataaactgaggcccagatttgttatgaagttaatttgagtgagaaccaacaatttgcttttctgcaatgccatgcctgtatcccatcccatctctgccagcaggaaaggatccctattcagtgttttctaaaaggttgtttatacggttgcaccaacgatggttgttggaagctttaaatgccattttaggaccatcaacacccacatcagtgcaagagagccccttgggaggcagcaatgataggaatcagtcatttaggtgggagaggatggattggcaatgcagtcatttggaaagccatgtaattcacctgctgccgattgtcagataagaagcatatacacaatcacccaagacaggaataacacttaatatttttctaagtgtttaaatagtgccacttattggtgattagctctttgcatgtttggaagaaaacaaaataaaatgaaatgcattattaggatactaagtcatatttcgttataagggatttaaaattaatttcatattttaatctgccaattatgttatttctctccagttttgaattaattaaaacagtaatggatctgtggtcaaagtttatataaacagattattgaagtactgagagaaaattatttctcacaaaaaacgtttttatttagctagttaaataatgtttcattttacactcagagagaaaagagaagtagaaaataactttgaggtttctaacatgagcaactcagcggatgagtttcacatagttagaaatgccatcatagttgtggcagattatctgcaaatagcgctgcagtaattctctccctccctgcatacccttgaggatttctatcccacagttgactctctggttgcccgtgtgacttgctttcattaatgggacaatagcaaatgcgacataaacagagacttgaaaagtgtgagttggaacatgtcctcttttgctgcacttgggaactctataatgcccaccattgcatgagcccaggctagcctgctggatgatgatggacactggccaagtcatcctctgattcacctgacacggagctgaccaccagacctatacatgaggccatctgggttgagctaaacctcagccacacctgcccagtccggaacagccagacacatcataagacattacaaatatttatctttcaaaaatatgtgtatcttttaagccattaagttttggggtggtttgtcatgtagcaaaagttaaatgttataaaaggtatcacctttcaacattgcatttagagagagaggaaaagagacagttaaacaattcattgctccatttgtctgttccattcatggtaaaacttactgaaagagttgtgcaaattcattgtctccacgtcctttttcctaaatatctttaatcatctccagttgaatttctgtctgctccattctcctgaacctgcttctaggacattaaactttcctggcctaccacctttgcctcttccaatctctttctgcctctgcctcttcttcccagtctctcaagtttgagcttccgggtcttcttctgtattttacactgtttccctattttacactgttttttccctacttccctgtattttacactatttacataattcattatgtcccatagctttagatgttgtctgtgtactcataattgccatatatacatacatatatgtgtgtatatatatatgtgtgtgtgtgtgtgtgtgtgtgtgtgtgtgtgtgtgtgtgtgtgtatatatatatatatatatatatatatatatctccagcccggacttctcttctgaatgccgggttcctatagccaactactcactagatatctccacgtggacatctgctaggctgctcaaacttaacatgtccagaacacttttttttgagacggagtcttgccctgtcacccaggctggagtgcagtggcgtgatcacggctcactgcagcctccgcctcttgatgccccaacctgggcccccaaccttcccctccaacagtaacagttactggcatctctgatcatccagttgagcaaacaaatgctagaagtcatcctcagttctttctctctccctttagatacaatccatcagcaaattatactagttcttgttccaaaatgtgtcaccagtgcattctcttctaacatattaggtgaaaacaccatcatttgttttctaagctactacaaataagctcctaaatggatcccctatttccaccatttctttgccatagtctattctccaagcagcagccaaaataatcatttaaaaacactcaacatataccagatcatattatcaccctgcttaaattctccaatggctttataccacaccacaagtaaagtacaacttccttactgtataatctagtttctgtcttcctttttgaccttgtctgattttcctggtagaatgtaaaattcatgaattttgttggtttcacttgatgatttgtttgtttggtggtgatatggttaggctgaggctttgcgtccccacccaaatctcatcaagaatagtaatacccataatccccataatgcccattcgtcaagggagagaccaggtggaagtaattgaatcatgggtgcggtttcccccatgctgttctcattacagtgagtgagttgtcacgagatctgatggttttataaggggctcttccccctttgcttggcacttcttcctgctgctttgagaagaaggttccttgcttccccttcgcctttcaccatgattgtaagtttttctgaggcctccccaggcatgcttaattgtaaatcaattaagcttctctgctttatgaattacacaatctcaggcagttctttatagcagtatggaaatggactaatacagttggcaatagtcaattcactaagcatttattgactaaatgatgaacaatcataaaattaatagatggctgtgttgcacttgttttaacataattttcttaaatatttttagtgcatcaaaagtatacaagatacatataccttaaaaattagtattgtaagtacccccatccttgaaactccctgtggtgacttttttttttttttttttttgagacggactcttgctctgttgcccaggctggagtgcagtggtgtgatcttggctcactgcaacctccacctcccaggttcaagcaattctcctgccccagcctccctgagtagctgggactacaggagcacaccacaacacctggctacttttcgtgtttttagtagagacggggtttcaccacgttggccccgctggtctcaaactcctgaccttgtgatccacccatttcgggcttccaaagtgctgggattacaggcatgagccaccgtgcccggccccctgtagtgacttgcatctgtagattggtcagtggatgccaccatagaattgggttccctaatcttgaattaataatgaaatcctggagtgataaaatagtacaattctacattttctatttctgtatacatattaaaaacaatagagtcaggctggcatcttagtatatagtgatgagaagcactggatttagacttgttttggatatgttcatgtgaccctctgatctactcgccatctgtcctctgttctgtgacctcagatgctgaaccctctctctcatcttctggcttaaggtcaatgtgagcattaacaggaaattgaaatgtaggagatggataacagtgtatttactcctcccatgctgggctgtgttgcccatatatccctctatcaaaggccataggttctggctggtggtcttttccatacagctactctcacctggttctggcaactcttcccttcatttgttccttcatactattgctagctttgatgtattgcaccatctctccactgaatcctgcccacacctttgtaaatcgcctctttattaacttgcctcaattacctagttgaatgttcatgctggtaccctgaataatacagtaattgataccagaatgagccccaagacacaaaaccctaaaatgaaatgctaggatatgatggatcacatatttaaggagtgcatagataacttcctttccaagagaaaatgggacactggtaatccatgtggattgagtggcatcacaataactcaaattatcatatggtgcaggtggagggcaaagtttggctggctgtggagtttggtcagcatgcagtgacagttattataaaagtggtgggatcagcttatatttatacttgccctataaagagtatgatggaggaggtaataccttgaaagtgtgattttcgactcagggcacaggtggaaaataagaaagccttgaaagcagcttaaatagttggcatctcctgaagttacagagcacatatagttgaggaccaagcttacaaactactgaatgagatcccgagagagcaggtacatttgaacagacacagacaaaactgagaactttgaagccccaactcccttgaacatacctcattggagaagcagaccctccagactctcctctaatcagatgatgattctaatcacatctgtggttctggtatcttttttttttttgagacggagttttgctcttgttgcccaggcaggagtgcagtggcgcaatctcggctcaccgcaacctccgcctcccgggttcaagtgattctcctgcctcagcctcccgagtagctgggattacaggcatgcaccaccacgcccggctaattttgtactcttagtagagatggggttcctccatgctggtcaggctggtcttgagctccagactttaggtgaaccgcccacctcggcctcccacagtgctgggattacaggcatgagccaccgtgctccgccttgtatctttataggaccaaataaaacctttttctggcacatagattgtagctaaccttcatctgcgtaaaagcttttcaatgatcgcacctgagatggtaacctcacagaataagatttaacatatcccagatgaaaaagtagcctagttcaagaggagaaacttaattagaaagagttttaggatctcaccaaatggtatcatcagtagtctagggagtgtgtatgaaagtgaattttaagtgggaaggcttttgtagctcagatgacagatagcatttttgcccaaatccagctcacaaagaatccagtgggaccatggacgcattgtgtagttattactcccgtcttagaatatacagtgggaatagacacactcggtaattggagaaattttcactctggcttcctgacccaggacgttagggctaatatagaaggaagggccaaatagaagtcctggaaatgccgtcaagacctcaacaagatagtaaaccagaagcaatgctgcatcactagggaaattacagaccaagtgtcaccataaaagacttgaaagatttaagggtggtgatttctatcacatccccatttgacttgacagtttggccagtgcaagggctagataaatcttggaaaatgactatagataatcatagacttaacgagataatggtttcaatcacagctgttgttctggacatgctaattttataggagcaaataaatagaacctctggcacctggtttgtagctagtgatctaacaaaattgtttaacctattcctatcagcaaagatcatcagaagccatttgccttcacatgcagggacagcagtatatctgcatatactctgggctatgtcagctctcttggtctctgccataagagtctggagagtccttgatcatcttgatttcccatagaatattattctgacacaataaaattatgacattatggtaactgtaccctgtgaacaggaagtacagtaagtaagccagatacatgcatgccagagggtgggagagaaacaccaagaagattcaaggacatttaagtttctagtggtccagtggtctggagcatgttggactatcacctctaaatgaaataagctgcttctccttacacagaccataacaatgaaagacacacagtgattctggagtcaacacagattacatttggttgtgcttgttgaactcattaagtaggccctggagcaagataagatactatggcaggtgcaggctgtggtgctagttgtcctgctgctgggccttacctctcaacagaccagtatcaaaagtgtctaagagcagacagtagaactgatggggcccccaagcagaccccaatgagaaaaacttctaccaacaattcttcatttgaaaagtaatacttggcttgctactaggccctggtagaaaactgaaagcctgtccaaggttttcatgaactaggtattttcttacctatattatcataaatctgtattgcacagcagcattctatgtaaaatagaaatggtgtatacaagactggacccaagcaaatccagaaaaggcataaataaaatgctcaagttgctggtttatactcccatggtacctggtcctattgctttgccatattgccttttatctacatttatggccttatagggcgtttcctttgaccagataatggaggaggtaaaagttcagacgtggtttatggatggatctgcatagcatgctagcactagctagaagtcaatagttattaatatatagccctacacataggtgaccttgaaaggtgttggtgaagggtaattctcccagagggcacaacttcaggttataaatctggttgtccactactttagcaggagagacagcctaagataagtcagaatctacagtaattctgattgactaagaagttggctgactgttcagagactcagaataaaactgaaaaatttatgtcaaagagaacaagggagaaggatatgaatggggttctcagaatggaaagtttggagatatttacttccccataaatgcacaccagaggtcatccacttcagaagtgggcccagtaatttggtacacaagataatgtgtcctgtgtatatttgtcagcctctttctccatctaccttcttgttaaagaataactttcaactgttgctaaccctagggttctgcactgcatgagtctgttttcacactgctaaaaagatactacctgagactggggtaatttataaaggaaagaggtttaattgactcacagttctgcatggctagggaggcctcagaaaacttagaatcatggtgggaggcaaaggggaggcaggcaccttcatcacttggtggcaggaaagagtgcacagggaaaatgccacttttaaaccatcagatctcctgagaaccccctcactatcacgagaacagcatgggggaaccacccccatgatttaatcacctctcatcaggtcccaccctcaagaagtagggattacaatcggtgatgagatttgggttgggtggggacacagagccgaaccatatcatggaccatctttgttggtttccattagccctgatctaactaaaaaattggtaggatattggttatcctgcctgcaactttttaacattcctcaattatccagtttaaatgtgccatctgtcttttaaagggattttgactgatataaaatgcaagtaaacttcaaaaaaatcctttcagctacttaaaagctctctgtaccctggattactctctggaaaatgaagacatcttatgcagagttgtatgttgaatgcatagttcctgatacatagctaacactcagaaaaaggtagtggttaagaatattagtcttactaaactaaaagcaaatttgaatgaaatttgccaggttaagtcgacatgtgatgtatctttaagaaatactaccatcaattagtagtaatcgccaacatttgctaaatactttatgcatgtcaagcactcttttaaccttataggccttatttcatttactcttcctgacaaatatgaggaaagcactattgtgatttccattttacacatgaggttaagtaacttgcccaaaatgagactgcttataagtagcaaagcttggattcaaatccaagtctgtctgactccaggatataagcgttcaccgctatgttctgctgccttcacgccagttcaaaataataacacacattgacaaatccacctgttgacatatctactgtattgtaccctatttatacacctccccagatttagtctgccaacacctgcctcccagatcctcatctgcctcacctcctcctacttccagccctttaatcagccctagggcaagggccaggttgtagtccaatctctattttgcccatttcagtgggagccacagggctccaatgcccagagaactgaactaaccagacacacagatgctatggctcctttctcccctctcagactctgaagtactgtggcaggagatatgtgatctggcttccccagcagctattcagaaaggctaggttttatggtttggctctgtgtccccacccaaatttcatgttgtattgtaatcccccgtgttggaggaggggcctggtgggaggtgattggatcatgggggtggtttctcatggtttaacaccatccccctagtgctgtctcttacaagatctgattatttgaaagttctctcccctctccccgccagccacgtgaagatgtgccttcttccccttccccttcaccttctaccatgattgtaagtttcctgaggcctccccagaagcagaagcctgtacagcccacagaaccttgagtacaattaaacctcttttaaattactcagtcttaggtagttctttatagcagtgggagaatggactaatacactaggtgacagagccttgagttgcagggggtttaacactctatatgttgagtagtgaccagcaaaagatgagacaggaagaaattagcacacagattcctctttcttctctttcttcctccttccaatggatgttctcaagagcagtggcttggtgcagcctgtcaggaaataagtcacataagtgagaaatcagctctattcttctcttgaagttctggtcagcttaatacatcaccttgcatttgcttttcctacttccctgtcttgtttccccttttccctcattcttgctgccctgaaattgcaccactcaattagggtgaccaattgtcccagcttgcttatgactgaggacattcccaggatgtaggatattcagtgataaaaccaggaaagtcacaggaaaactccattctcataaagtattagcatgttttgagtaaacattgagttaggccctgttttctaaataatccaaggtgtgacaattggtagcaggaatgactatagaaagccaagtcaggatgggattttggagctagaatgaatgataatttgaaagcaaaacgatttctcttgctggtggtcatttgggacactaataacctatgatatccactagcatcagggttactcgagttactgcataggtatgtggatttattatgatgaagtataaattgagggcaaaagattaggagatcaagggctgctccttttgatcaatatgggggtactagaaattataaaggtggtcaagtagggtggttgcttttgacagcattggatgcctcgcaacaaagaagtgttaggctcagctcacctagttgtctaagacactatgtgaaggtcacaaggccttcatggcagcatttggagagatcctcgtctcatcagccaccaggcaggctttgctgaaaatctggctcgggatgtgattgtagcagaatggcaaaggagactgaatgcacagtctcaacagttctatgccaaagtcaggcccctcataacaaaagaatgggaccctgagaactaggatggggacatttgggtaggcaagcctgagaatcttaattccctccacagtcacttggacttgcagaagcagctcccttccccatgctaggaggtggcagcctctccacacctggagactctggaaagaccccacctgtcctagtccattcttactgctacaacacaatgccagagactaggtgatttctaaagaatagaaatttacttatcacagttctggaggctggtgagatcaaggcaccagcaggtttggtgtcttgtgggggtgcattcctcatagatggcaccatctaggtgtcttcacatgggagaagggacagaagggtgaaaagaaaaaaggaatgaacgtggtgtcctcacatggcagaagagatggaagggaaaagggacttagggcactccttcaacctcttttataagtggctcctaaaggacccacttcttaatactatcacgttggcagtgaagtcttaacatttgaattttgggggacacattcagaccgtagcaccatcagagacagatacctctcaaggatgcttatcctcctcaacatttgccttattttccctcactgctgccagaccagtaatatgagtcaggtaacagcacctgccaagaatggaaatacaatccgtgttctagaaggaaatggcatgcccatctaaacaattgcaagacctggtctatatgtacaaacaagaactgtggtgacaccagtgggagtaaaccacgggagtggattataaggctggattgggaggaatgtattgtcacgggatgactttgatgactcagagtttgactcctggcaaggacacccggggctggtgttaatacattactgggatagttccttgaagcttgagcagacaggatgatgatctatggcaggcatgctggaactgcctggtagaggactgagtagaggtcacgaggtcagggagggagaacgtaagaatggactaagtgtggctcggggcctgcacaaggcattgaaaatgcctagatgagttcatgtaactccataaacacacaggttcagagcaggccttttaattaatttttagcgaaattacatcggatttgtttctctgggaaggccctcaggacacttcctttattaaagaaataagaaatgcgttggtcaagagggcaatgctattgttgaaaaactcgatgtggctatccttagtataccaacaatgaaaatagatatggctgtcctctgtatgctgacactgaaaatagaagatgccaccacgaaatgaggcctcctagtatcaaagagggtgggtgcaggttcccttgccctctggtttccactggttttagtcagaataaagcaccagcaagacagcagtgaacttaggaaattgattcactcggaccctcctggtggggttgccatgggctggctgtttacttcaattgaatgtcaaagtttctctaaggctgccttctccacacggccttcctgcctccaggatcaggttccctctttcaccctttagactcaaggcccccttttactagctccagggtgttataccatccctctgggctttccagtatgctgcttcacttttgtaaatagtgtctcaattaaactatcctcaaattacttaatttgtaccatcagtttcatgtcaagatcctatgtttaggatagatttggaaatttttctcaaattttggagatggaaattgtgtggctagggaacacggattgaagggaaacttttcagtgtatacttttgaattttgaatctgtaaatgtattattaaaaaatattccacactcatgtgcacacttaatagccaggttaagtgtggaagggagtagtgacagaggggagacaatgtggcaattgatattataagcttcaaaaatgcaacacagtatttccacttccaggaacttatgcttagaaaataagtgaatatacaaaaaaggcatgtacaaaaaggattcattgcaacttatacaagagaaaacttgctgacaatataaatgctcaataatacaggtgtttataagaaaacatatgacagaaatctctgagctatcaaagattatgctttgcaaaaacatgttgaagagtgcaggagaatctcataatttaatgttaggtgacagaagtagaatacaagggctgggcacggtggctcatgactataatcccagcactttgggaggccgagacaggcagatcacttgaggccagaagttcaagaccagcctagccaacatggtgaaaccccatctctactaaaaatacaaaaattagccaagagcggtggtgacacctgtaatcccggctacttgggaggctgaggcatgagaatcacttgaacctgggaggtgacggctgctgtgagccaagatcgtgccactgcactccagcctggggaacagagtgagaccctgtctcaaaatgaaaaatagaagtagaatatgaaagaatttgtacaattttgtaaaatgtacagtatgtgtatagattatctttattttaccaataaaggcattgaggcagagaatagtaaaatacctatatgtgctcaagggcagagggtttatgaatatggattttagggtctacaagtaacagaatatccaacttaaaggagcttaaacaataaaagtgtttaattttctcaccaagagatctgagggtaggtaattttagagttggtttgaaagctcaattatgtcattagggacccatgttctttctatcattccatttcagctttgtggccttggacttgtcacctcatggtcacaaaatggctggtgcagctccaagtattacatcatcacaggacaatgatcaaagcaggaaggccttagaagctaactgggtttggtcaggctctccatctacgccagctctttgagggacccatgatgcaactcggggtttatctaaacacatctatactcggtaatgagctgtcttatcattagagtctactactcttgttgaaacaactttaaataaaaccagaaatagtctaccttttaacagattcccttcattcataaaatgagtgggttggactagataatctctgaggttccttccatctctgcttggttctgattaggaaaaagactggctgaaaatacttaaaattattaattgtggttaactttggatggtgagattatagaggattctttttttcattccacaaatatttatcaaacaccttctttccttaaattccaaattcctcatttgaggcagtccaaatgctcagccgtcccaaagctgttctactctccatacaaagctttagtttctccagcatttccccattaccacgtctatagaggatttttttcttcatggttttcttttcaaaatttttatcatgatgtgggttatgtatgtaatgagaaaatatatcatttttaaggtataagtgttttaaactagaaaacttttttaaactacacatgtaatatgtgttgttgttgttgttttgttcatctgccagtagttcagtgtgttttaataaaacctattgctgtactttgaccctccagttgtataggtgtaaatgtcatctgcagttatgggccttttagtaaaaatagcagacatgggtaatggtggatagtaagcaagctatttcttcttgtgtgagctcaattgctttaagaattgaaatccttccaagaaaagccacagattcataatgcatttaactgcctgcaaaacttagttatgaatgacaaggttgtgaaaataatcacatctagacttacaacttggaactggatactaatttttgtgctttgtttctcatggaagctaaactgtctttcaacaagttccaaagtcttttgggtccaatgcacctcacaaataccttaacatttgtgagacactgatgcattaaaaaaaagaacaagagagagaaaaaaataaaaagaacaagagggtgaattttcacattttccccatgaggctcatttccaaggtaagtataatggagcacacaatctagtaatagaaatgtacccgatattgatcagtggtaaatatttgccagacactgtgctaagggctgggtatgcactgtatccatccacacagcaatcctatgtggaaagtagtattatcccattttatagaagagatcaaggctcagagagaagtgatacttgtgcagagtcacacagctaataaatgaggaagacaagtttcaaacaaagtcaatctgattccaaagcacaagcttttaagcacttgctatatttacctaatttttctgtttattgcatttagcccaattatctcttgaatttagaaggtacctgattctgtcctaggaagatccgtattttattttaaactatagttcattttctaccctccatatataatatatttatccaagaattatgcttcctctgtgtgtaagggtgccttccttctctaggtgagaatgagttttgtttcttccctccatttttagaacagcatctatcctgtttaatcctggactgttttcttcttccctcaatttcattgccctgtattctccattgctctaaagcttcctggacctgaactaggattgactttgtcctataattcatttgtcttagtcagcttcacctgctgtaacaaagtgccattggccaggtagtttatacacaacagaaatctatttcgcatgattctagaggctgaaagtgcaagatcagggtgccagcatgatcaggttttggtgatcaggttttggtgaaggccctcttctgggttgccagtttctcactgatcttccacatggcagaaagagagtgaaagagtgctctgggtccctcttataagggcactaatttatttcatgagggctccagcctcatgacctaatcacctcccgaaggcctcacctcctgataccattaccttggggattaaaatttcaacatatgaatttggcagaggaggcagcggttgtggggtggggggagcacaaacattcagtccattataaatagagaaatattaaattaagtattatttacttaaacatttaattatcaggtgattctgagcagcatttcactgagagagcataatataagatgaatctgattttctctcagttgttctgagtgtagcatctaacagaaggtgattcattcattctttcaacgaatgttcactgagtaattactatgtgccagtactactctagggtccagtgatacaataagtaagagaagatcatttggatactactagagagctttatactctcatgaagcttatgttatactgcagagaagccacaatgaacaaatagtaataataacgtctgaccgggtgctgtggctcacacctgtaatcccagcactttgggaggctgaggtgggcagatcacgaggtcaggagactgaggccatcctggtcaacatggtgaaaccctgtctctactaaagaaactttaaaaatttgctgggcatggtggtgggcgcctataatcccagctactgggtaggctgaggaaggagaatcgcttgaaccctggaggcggaggttgtagcgagccgcgatggcgccactgcactccagcctggctacaaagcgagactccatctcaaaaaataaaataatgtctcatagaggtgagtgacatgaagaaaataaagtaatgagaccaagaatagctgatgggaatagtagagatttcttcagaagctttgtaggaaaggcctctcaggctaaaatatgaatgatgagaatatagccatgtggaaaaaatatgtgcaatgagcacttctagtgaaaggaaccaacagactaaaggccttaagggaggatatgtatggttggagtacagagactaaaggagacagtagttcaaaatgggggtgaagtgttctgctgagtcctgatcatggaggctgtggtatgagtttagattttattctaagcagtatagaaaatcactggagatgtgttttatttttaacttttattttgaaataaattttagatttacaaaagttgcaaagatagtactgagagttcctgtgtacttttcacccagattaccctaattttaacatcctacataaccatggtacaagaatcaaaactaagaaatgaacattggtacaatactgttaactatacatattcagatttcacccatttttgagctaatgtcatttttctagtccaatatccaatccaaaatataacactacatttagttatgtcttcttactctcctccaatctgcgactgattctcaatctttctttgtcttatatgaccttgacaattttgaagagtactggtcaggtattttgtagtgtgtccctcaagttgggtttgtctgaagttttctcatgattagattgaggttacaaatttttgagaagaataacacaaaggtgaaataccttccccactgcattatatcaagggacacatcatatcaatatgtcttatcactggtgatgttaaccacaatcacttggttagggtggtgtctgatttcttcactgtaaagttacttttttttccctttccacattccactcattagaagtgtgtcactaagaccaagccacattccaggagaggagaggataattaacttccacttcctagaatatcaaagacactgtggacatctgtcagaagcaacacaataatcaataaatatttttggaaagatactttgagtctatgcatatatacctatgcatatatatacttcaagtgaagtggcattatttgaagatggaattacattatttcaaaatgtatagagtattatatatgtgtgtgttattcattctgtttgttctctgagtttcttggatctgtggtttggagtctgtcattaatcttaagaatttctaggccattgtttcttcaaatatttcatgttccttgttatctctcttttgtcctgaaattccagtgaaagatatgttgaaccactagatattggcccactgctcctggatgtgctgttttgtgtttttccttccttttttctttgcattttggtttggatgatttctattgacctatcttcaagttcactgattttttacttggctgtatcaagtctactgataacaaaggcattgttcacctctgttactgtggtttttatctttagcatttccatttgattcttttttataatttttatctctctcctaaaatattgcctttttccattacaacctttaacatattagtcataattatttttaattctccatctgatttttttaaacatgtgtgtcacatctgagtctggttctgatgattgctttgtctcttgggaaggtgttcttgccttctgggggcatgcttcatatttttgctcaaagcctatatttcacacaggacagtaaatagtgaggtaaatatttttacacttggagctgagcatgccttttcttctactaagccttcagcatgaaggtttgtgttaacctagtcagggtgtgagatttattgttgctatggatacccttggtaaaacaaaggcttcaaattcctctgtgatatctagtgtttagggtgtgggccaggtttgctagaggttactttctcaatgtttcctttttttcaccttgagttttccatttgtgctgcaccacagtgagagtataatatgtctcttgcagctcttcagttctgttctactcttatttttacctgatgcttgttgacctgtggtgagggccaggagatgggaagattctatgacggtctgactaaccctcagttttaggcagaggctgtgtcactgagtctcaggggcatggccttcacaaatgctcctgccctgcctccagctgcagttttggtctagcacatatttctgcctttccttcagaaatagagccttttttattcaactgtcttccccagctgcagtgggttttcaccagtgccctaagatgtctgtttttgttattcttacccctacaaatttaagcttttgttccacagaggaggtaggagagatgggttgagcgcagttttagcagtggctgctgttcccttccccagccagcaccatgctggaagctttatcaggattctacccaatccttcctacgaatgcctggtggggtttgcagaggaaaatcctgcaagaggataaagtcttcaaactagcccacacttggcctttagcaatttattaaaagcatttagctgaatcctcttagcagcttatatggaatccagaagcagctgctccagattagcaaatgttcaggtcctgtatctccttgaaggaacctggcttttcttagattttgggttacactgtagtggccttataacctcggttctctggttcaagaaaagtcattaatttgcagtttgtccaaatttcccttgtatgaataggtgggagagactctctttccagctctctgcctctctaagctgaaaccgtaagtccttattggagggtttcaagcagtgtagtaatgtgattagatttatattaaaagctcactatgactattgtatggagaatggactgtagaggtctaggaagagggcaaatgggacagtagtaaaactagataggacgctattgcatttattcaaataaaacatgttggcagcttgacttggctgctaacaatagaaatgagaatgggtgggtatttcagaacaagttcccgaggcacagtggaaaagaattgatgattggactatatttgtcaggattcagtcagaagattgaaaacacaccagtaatttgaacagggaagatttaatataaatacctattaactagtaacaggattaactactaggagatggaaactaactctacaggaatagcagatgaaggaagcagccactatctctagggctgagggagagcagtctaagaaggaacaaacttgaaagagggcacattcttaccaccagggcggaggtttagatcttgttggagatggtgtggctgtagccccgtggagggcagagaagctcacggaggggtgaaaccagtgtctgggggccagagaaactgactagaaagctgcctgctaaggtactggtgaaactcgctgggaagctgcctctgtgatgctggcagaactcactagttcttagatttggtggttaaatctgagaaatatactaccctttggtccagtaattccattccaggtatttactcaagagaaatgaaaacatatgtctacaaaaaggcatgaaagaactttctgggatgctggaaatgtactatatctccatcacagtggtgtttacacatgtgtatacatctgtcaaaactcattgaactttatacttaaaattagtgtcactacaggagggggtgttggagaaagaagaaagtgtgaagtgattgtctcagatatggaaagtgaatttccaagagagacataataggaatagccaggagtgctgaaggcctattagagatttgtggtaacacgtttaaattgagagtgctcggatgggttgtggtcattttctacagcaaagctcagcttctccagtaccgatgcagaataagatagttggctgtggccaggattagaaacttgctggggagcatgattaagggagaggtacaaggggtgcagctctgtgtgtcttctgctggtcttgccttctgcagtctcagtcacctagtacctcagctgggactgaatggtctaagacggtctcattcatatgtctgtcagatggtatgggctgggccacatgtctctagctgatcagcctagatttgttcatatcaaaattggattcaaaaagcagcataaaagaaggcaagccccaatgcacaggcacttgactagcgtctgcttgtgtcacatttgctaatgtcccattggccaaaggaagtcacatgtccaagctgagtgtctgtggggtgggggtgggggaaatacaccagggcttggagagagagttgcaatgtgtggagggccattaatttaacaaccacacggagattaggggcagttctctcttcctacagccagtaaacaacagctaaaacaaaacaggaaagtgagccagttactctcctggaaaaacatcattttccttagagtgttataacctaggctaggatgcctgcaatttttctcaatgttatgaaattctaaagacaatcaatttgaaaaatacatgtgtcattgaacattttgggaagagagtggtcatacaatgagataatgatagtgtttagaagcttccaaaacttgttaacttggcccttctgttttgaatgagcatattcgtagacaggagattgaaccatatgacctttaatgttcttttccactactgagattttgttataaaccatttagtaatcagtctgttacagctcattctgtcttggctgagaaaatgtcctttttccttacaagcacatacacatatgcctctccataaggcagaactctgaaacaaatgacagtcctgtttcataatatttgtctcctgatagaagaggaccagcccttgagttattttcacctcattagcaaaagtaaaaatcatagacaactcccagaattatgggaatggaaatactgaaactttcttttacgagggctatttctgatttttaatttttctttgaatcccagaaacttggagttcttaacccctattcctaggttagtgggaggaacccccatccaacattagaaggaaatgttgaagcttggacgtcaaaaaaaaaaaataggcataaagaaaaaaaaagaaataatcattaatgtttctatggtgataagaaagaaaaatataaatatatttattgttctctaaagaattctatcttataggaaaaatccttatttcatataaaaacatgaaaagagagatttgctgacccagagttagatcctcgagtatttttatttgctctgctggcacagcaaagcttatgggcaacttaataattgcctgagtgcccaaaggttatggatcaatcactcagactgccagtcatgccaagtcgcaagccaggaaacagtcagagaggcttgggatcttttttcacgaagggaaaatggcttattgttagattcagaggaaaaacagagtgaaaggaaaatgctattgagcgtacttagtgagaaacatcatttatatccgacagtagcacatttttaataatgagaccagcagggaaaagacagatctggaaagaccttatagcaagagctttgctcagtgagccagttcagctgttgtgaagtggacccaaaagtccacaggggagaaaagaatattatattttaaaaatgcagtgtgcagcatttacttttaagcagaaaaatgcttgagtcaactccacgcactgacttgatctcatatctacaactcatttattcttgctagctaaaatttcttggttatacacatctgaattattcatttatttatttatttatttatttatttatttatttatttgtgacggagtcacgctctgtcgcccaggctggagtgcagtggcacaatctgggctcactgcaagctccgcctcccaggttcacgccattctcctgcctcagcctcccaagtagctgggacgacaggcgcccgccaccacacccggctaatttttttgtatttttttagtagagacggggtttcaccgtgttagccaggatggtctcaatctcctgacctcgtgatccacccgccttggcctcccaaagtgctgggattacaggcttgagccaccacgcccggccacatctgaattctttttaaactgagcttattttttcaattatgaaagtattctacattattctttaataaaagggaatttaactcttgccacaagttagtattaggatgaatcatatggaattgccaatattctactatttttgaccctaaaactgcaatcccaaattgttcaacctcaaacagtacctataaataattagtatatgatacatttggtgttttatatgtgtggagattacttaatagatggtcctgttcctggaactattagacaagtatttgggacagattaaagagccttgtatcaacccatacacaaaaataaattccagatattaatttgtaattaaatgttaaaatatagaaaattaagaaaatttggatgaatatttacataacttagggggtacagtaaacatttcttaccaaaaaagcgtaggagaaaagtcatgataaacttacaaaaaagtttaagtgcaaaaacatcaatacatttctttttaaaactctgtaaagaaaatcaaagcacaattttaaaactggggaaaatacttgcaaactatatgacagtttaaaaagttgggatccttaatatgtaagaaactcttatcaatcaatttatcagaaagagataaacactccaattaaaaatgggcaatttccaaaaggagacataaaaacctcacaatcaaggctaatgcagttgaaaacattagtgagatactaagtgttgtctttcaagctaacaaaaagaatgacaaaacaggcattggtgagagtatagagaaataaacattcttatagctggctagagagatggggcaattgctaatttgtgttagaaaatcttaaaactactcgtatcttctgaatccacaattctaccttttcttagttatcttaaggataaaaccacaaatatgcccaaaggaacatttataagtatttcatcacagtgaaaagttggaaactaaatgttgttaaataattgaattgttcagaaatcatgacatccataaagaaaaatactacaccagctataagaccatgttataaaaatagttctaggcttgggggaaggtatgctatttacatgaaaagaataaaaggctatcaaccaacatgtatgctgtatatcccaaggtggtggtgaattcacaccatcatttaaactgtatacagtggcactcgtgccttatttcctggtcttggtcaatcaccagatatccagtaggtactgagatgcatgatagtgatgtcactacctacacagaacgtaattagatcccaatgtagcctccttctccagaatgaggagtggatcatctagaatcatttgacagttctaggttgtcatgttagtggtggcgtaggaaggagtaagataaatcccactttgtgggcccagtgaaatctggcttcaataacactgatactaataatagcttattattatcctagtggcacctccttccctgtccccaacacttctcccttatcctacttttttccttctgcatatacatcatcttctaatactttctataattgagatatttattatttttattgtcctcctcctccccctggtactaaggcagagatttttgtctgttttattcaccactgtatctccagccctagagcagtacctggcacacagcagaacttcaatcagtattaatcaaatgaaggactgaataaaagctatatgtatcccatgcatcaggaactttaattcaattagttaaggatggattttagggaaaagggatcacaaatgggcaacacaagaggcatagctaaaggggatagtgggagctcactctctttgccttgctagtggctgtgagggtgctgggtaagagttgattagtgataagtgagccatatgtcccttttaatgcaaacttgaggagctgcctctatcgctcccatgaattgtccccagagacactgcccactggatccacaatgagggacccaaaatgagagacctaggaacactcttctcctttactctcttctaggtttaaagctcatgggcccttctccaacaatccagaactctgaatcaggaattggaggagtatgtgacaaaacagtagcattaaattatgtctcaacaaggaggataattgggaaactaaggaaatattcacaatgatattcatttctaatgtttttttttcttaatccacagtttggcctcactacttagaacccttcttttgctttctatattcaaattcatcattcccagaaggaccatacttttactcttgaaagactagttctttgaatcataccccataattatgttcattctattttcctgatgaacaagatcagttttgagctccactgcattccagcctgggcgacagagcaagactctgtctcggggaaaaaaaaaaaaaaatgtatgtcctgcccttcttttcctctcctcatgttatctgtcatagccactggcttttgcctctttgctgatcattagtttgaatgtgcctactatgaataaagccttcatttttatgttttaacaaaagaaaaaaaagatatctccctctgcaagtacaaaacagccaggtttcacaacatgaacaggaacttcaaaattattgccagttcctggcatgcagataattcttccagaattgcagttttttccagtccaaattatacttgaaaaactaccagctccctagaataaactctatgcaatgtccagctcataccacccccacaataacaggaagaatactgcttcatatttctcccttgaaaggcaatgcactctagctgataagagatcagaacagataccataaaacctggctgtatttatgactctacttcttagagactgtgtttttttcttctctcctcctctcctcttcccttcctcccactcctttttttcctttcttctccccaactgctctcttctctcctaccctcccctttcctgccattcccttctatcctctcctctcctcattttcttgtcttcgctccccctctctctccttctaaaattaactattcgcggccaggtgcggtggctcatacctgtaatcccagcacttggggaggctgaggcggttggaccacagggtcaggagattgaaactatgctggcctacgtggtgaaaccttgtctctactaaaaatactgaaaaattagctgggcgtcgtggtgcatgcctgtagtcccagctactcaggaggctgaggcaggagaatcacttgaacccgggaggcagaggttgcagtgagccgagatcacgccactgcactccagcctggtgacagagcaagactccatctcaaaaaaataaaaataaataaataaataaataaataaataaatattcgctataaatacactcatactagggttgacaataccaagtgttggcaaggatgtggaagaactagacatacattgctggtggaagtgtaaaatggaacaaccactttgggtaaaggtttgacagtttctaacagagttaaaacatgtatctaccctatgacccagcagttctgctcttaggtatttattcaaagcatatgtaaacatatgtccacaaaagacttgtacaagatgtcatagcagttttagtcagaatatctcaaaactagaaacaacccagatgtttgttaataagtgaattgatacacaaatggtggtatgttcatacaatggattattactcagcaataaaaagaaagaaactccaggtacgtgcactaacctggatgaatctcatcaagttgaatgaaagaaggtaggcacaacacatacagcacatactgtatgttttttatttatataaagttttggaacaaataaaacaattttatggtgatagaaataaaatcagtggttccctggggcaacaggaatggtaatggtgaagggatataaaaggagaatgagggaactttctgggtacggtagaaatgatttatatcgtggttccaagcctgtctgtaattgtcaaaactcattagactatacatttaataactatgcattttattatgtgtaaattatgcctcaataaagttgatggaaagattcatactgatgtccaagaaagagtttagaaaatatttatttcccagattacaaggataaatcttgcatcagcctctctgtaaattcacatattcggtaggctggaggaggtgggttgaatcagtaaggtcacgagtctgttggtaaaactcctgctatctgcctcattaaattcaagagatagtcactgagtgcttcaatctgtagcataatatgttaggctttattggaaatataaagatgaataattcagaattcccactctccagttgctaattatttttggcctaatggcgatttaaaaaacaatggtcatgcactcaactaataattgtaaaataaagaataagcggggagcatagggtcatgcttaatgcatacttaatactcaggaacatcacaacaagctgttggatatcttatttatacatggtttctaggccttctggaaagaatttcgagggggactttgcagcccaagaatgcattagtaagcactggaattaatactcttccaccagaaacttaggacagggttgtcttccttcccctggaaaggatggccaaggaatataggggacaagcttaagatgacattgagtcaaggggtgagcacctactttgagacacagggatgggaatgacagaagatagttattagaattgtcaagaccagggctatctagaacagcttcacatggtctttggctaggtctacattaaagaaagttgcaaaactggaagggtaggtatattagagtaagtcatctcaacagttttacacaatgaaagtttatttcttcctccctcaaagtgctgtgtagacagtcttgtttgagcagctctcctgggcctccaagtggtgactgggatccagattcctccattttgtgacttcagagtagctttggtgccatctagcaccaaacggagatggagaaacacacacataggagattaggtggaattttttatgggttacacctggaagtgacatacatcagttcagtccacattccaaagaccagaagtcagttacacgatcccacttagatacaaaggtggctgagaaatttagtttagctgcgtgcccagcaaagaggagaaccagactggtgaatgccaacattcttgaccacagcaatttgagaactataaatatgcagtgttcaattactcaaaagtagctgaaagagattccataaagcaggggatggggagtagcattctactttttgagcagaagctgctgtgcaggcagggcatggtggtgattcatgcctgtaatcctagcactttgggaggctgaggtgggaggatcgcttaaggtcagtgttctggagttccagaccagcctgggcaacatagtgagactctgtctttacaaaaaaaaattttttttaatgctgtgttccttattgggagtaggcaagcaaatcttcaacagttgagaccaaaagaacaaccctgtgtggcaaatgtttggttatccaaaagccaaagaagaaggaaaaaaaaaaaaaaacagcagaggtctgagatcagaataactctgtcacaaacctgataaaatggctgctatactttgatgacccgaagcctggagttggtgtatgagctagatgtggtggctcgtacctgtaaccccagcattttgggaggccaagggaggaagattacatcagctcaggaggttgagaccagcctgagcagcataataaggcctcatctctacaaaaatttaaaaatcagccaggtgtggtggggtgcacctgtaatcccagctacttaggaggctgagacaggaagatcacctgagcccaggaagtctaggctacagtgagccatgattgcaccactgcactccaggctgtgtgacagaatgagatcctgtctcaaaaaaaaagaaagcagagactcaaatagacacttgcgcaccaacgttcttagcattattcatgatagctgaaaatggaaatagcccaaatgtccatcaacaaattaatggataaacaaaatgtagcatatacatacaatgaaatagtatttgaccttaaaatgttataaaattatgataatgcttcaacatagatgaaccttaaaaacatcgctaggtgaaataagtcagacacaaaaggacaaatattgtgtgatttcagttatgtgaggtatccacgacagacaaattcatagaggcggaaagtagaatagagattaccaagagctgtgtggaaacagtaattaggaattattgtttaatgggtacagagtttctgtttgggatggtgagaaagttctagaagtagtggtgaggattagataacattgtgaatgtacttaatgacactgtacacttaaaaatggttaaaattataactttttatgttgtgtatattttgccacaataaaaaaattttcagaaaaaatgagggacatggactctctaatagagaaacaaataatctgttaagagccagacaaagatttcagttggtgtatggggatgggaggaatctagtaaggcttcatagaagacagaattacttcagctgggcattggagaatttcaagctggatttggagaggaagaggacagaggaaaggtgtatttcaggatgcggaagtgtgaacaaaggcagagtcataaaagtatgtggcatatctaagaaatggtgattagcctagtttactcaacacatctcctgctttccgtcgctagggttactgatggtattcctttggaactacgttgggtgattgctagttgctcaacacttcccagcacctggggcacagaatactcctgcctggcttaacaggagcaacagtgaccctcagtcactgcacatgagggtttctactttgttcacacaagaggagtttatgtaactatgcaacatacatctattacctttttcaagggagcatcattgtgttctggagaatttcatccaccaaatctttttatatattgttagatgcatggacagataatacttctgaagtgttaatcagtatttttttctccctattgctggctcctttgtttctccttgttctaacagataggtgagttcgtacatgctgcctcaaaggaggaatgagacagggtggtgttttagattgctacaaaagctagacatgactccttttccctagactaggcatcgtttttttaaataattttttattatactttaagttctggggtacatgtgcagaacgtgcaggtttgttacataggtatccacatgccatggtggtttgctacacccatcaactcgctatctacgttgggtatttctcctaatgctatcccttcgctagtcccccacccccgacaagccccagtgtgtgatgttcccctccctgtgtccacgtattctcattgttcagctcccacttatgagtgagaacatgcggtgtttgattttctgttcatgtgttagtttgctgagaatgatggtttccagcttcatccatgtccctgcaaaggacaggaactcgtccttttttatgactgcatagtattccatggtgtatatgtgccacattttctttattctatcattgatgagcatttgggttggttccaagtctttgctattgtgaacagtgctgcagtaaacataaacatatgtgtgcatgtgtctttatagtagattgatttataacgctttgggtatatacccagtaatgggattgctgagtcaaatggtttttctagttctagatccttgaagaattgccacactgtcttccacaatggttgaactaatttacactcctatcattttgatcctttaaaaatcagcaagacatggccgggtacagtggctcatgcctgcaatcccagcactttgggaggccaaggtgggaggatccattgagcccaggagtttgagaccagcctgaacaacatagtgagaccccgtctctactaaaaataaaaaatttgccagccatggtggtgcatgcctgagtcccagatactcgggaagctgagatggaggattgcttgagcccaggaggttgaggctgcagtgagctatgaccatgccactgcactccagcctgggcagcagagcaaaaccctgtctcaaaaaaaaaaaaaaaaaaaaaatcaaaacaagtttctgaacatcaggaatcaggtgtgtttatctgtgagtgtgattttgatattaactttttcttcgctgtccaagataattgtaagtgacatcgatagcgtattatctctttagctgcagtttccgcccttctgctgaaaattaacttaaccttctcacctctgagctgttctgggtcaggagctgctttagctcatctggtctcaagaatggattgaccacattccatggccaagccctgtaggtccgcctggtacattctttgaaggagagagatgttctgatcattttatgacttgtcctggggcaaaaatgaagagctagagggacagccaaactgaccttcatggctgatcaagtgctagtctctctgtagtgactgcatcaaacaggaagtgaacataagttctgaacacatctttttatagtagaaaaaaatccaaccattgtctagctaagtgatcaaaactaacaccggcaataaagggcaagcagatacgctgtgcctccagatgagatacctggataggatgtaacctcactgcattgctctaaagtgacaaacttaaccttaaaaacatccactgattgctttcggaaaatgtggggcctacttgtagttagttcccttggtagaaagatgtaccctcccaggcccggcgcggtggctctcccctgcaatcccagcacgtggggaggccaaggagggtggaccacttgaggtcaggagttcgagaacagctttgccaatgtggtgaaaacctgtctttactaagaatacaaatattaactgggcatggtggcgggagcctgtaataccagctacttgggaagctgaggcaggagaatcacttgaacccaggaggcggaggttgcagtgagccaagattgcgctactgcactccagcctgggtaatagagtgagactcagtctcaaaaaaaaaaacaaagaagaaaaaagaaagatgtaccctccctatatccatcccaaagcagtgcttctcaaactttagcatgcttgccaatcacctggagatcttgctcaaatgcagattctggttcattagatctggagtggtgccccacattctgcatctctaacaagctcctaggtgatgtggctgttgctggtctgcaggccaaactttttaagtagcaaggtcctaaagcagtggttgcaatgattctcaaagtgtggtccccagaccagaagcaacagcatcacctgggaacttgttagagatataaattctcagaccccaccgcagacctacttacttactgaatcaaaccctgggtgtgtccagccagagccggaactaatgttaggaaaggaagttgcctagggcgcaaaatgtaaggaggtacccactcagagtagtgcaagtgcagtgtgtgagagtgtgtcagccctgagacagaaatctgtttgacagtccctcctggggattcggatgcctgctagaatttgagaactcttgtcacctttcttctcagtaaatcacctcactgctatagcagcctggttgtatctatatcatctgggctccaattgagacctattgaatcagagcatttggaagtagaaaaattttcatctggttaggggatgtgaataagaatgccagtcaaagagctgtttgtcacaacaaggatatataaaggaaaacaaatatcagctatgatgcattggataagcaaaaggtgtggaggcatatggcagttagaagtacaaagctagatgtatcatagagctatgcaacaagatcttaaagagttggacaaaaatggcaagaaacgtgatttagagcaatataccatttatccaaattgaaaattcatattttcaaacactattataataaagatacataaatagggtaccagaggggaagtggaatgggagtggaaccaaggataaggtcccctttacactttggaacccagtaatccagtaaatattatgatgtttcccacccctagatctttattcatgctgtgccactcttttgatctttcttcacctgactaactcctcttgattcttttcaattcagctcaggtgctatcacatcaggacagtgtctctgacctctctggctgggttaagtttacccgttggctttcatagcactgggctatttagtcatatgacattttattaatactagaatcattggtctgtgtgtttttaagcctctccagcccaagaacctgctcttaccacgtttaatagcttagtacctgtcaatattgcatctgcaactcaataggttcttgaatgtggtagggcttaaccttaaagcggatgtagtagggcttaaccagcactaggaatattatttaaatcacttacacaagaccttgtactgaaaggacttaaggcagcacttgataactaaacttcagagaaggggaaggtggaatttcactgtaacaagccagcagcaaaagcagtcccctgcagccacagggatccatcatggctgcctctctggacagatcatgatccggagcccagagcctgcaattctggctgtggctggtcagcaaatgatcttcatctctgccttctactgccatctccaggggactggttgattttcacccagctgctggcctccagctgctgggagaaagtcacagctctgaaataaaaccaccttcatgaatgataactcattctaaccccttctcttccaggtctctgagagaggtattgcaaaccccacgttttcctgtcaggtagagaccagaagaccattttctactgtgtactcatgtacagcaaataatttctgaaagtatagcctcataagaaaactcctaaaatacaaattgccattgcagaaccagggagtttttttgagagattaatgtagagaattggaaagtccatgtcttaaaagattcacaaaccttcccttaagaaaacatttgcaattatagttatgtttccctcccacagaaaggaaaataaatgtttcatttagagcaatcttagaataaaaagacacctgaaacaatctaaaatgaatttgcctatttcctgaattttcttcagttttatatcattatgtttctaaaagaatcatcataaagttttggttatttttttaacacagcaagttattcttgcttaatagaaaaccacagtttggtaaaatctaaattcaattggctagaaaaacctttcctataacctgtaaagtactctttcaaaatgagtcaaataataatcaggagaaaagaatgggataatcactagaacaggatttcctagcttcaacactattgatattttgggtaggattattctatcttgtagaggtagggagagagggcttttccatgcattgtgggatgtttagcaggatctctgacctctacccactagatgccggcagcgctcacccacctccagtcatcaacaatgtaaatatcccctggatgagggagttgagaaccactgcactagaatgagacacaaagccattcacagataagatggagtctgtaaattagaacgtgagacggaatgcacaaacctttcccctaatgtaaaccccaaggatttgactttctaatttgaaagtgtcgaatttgttaaaaactgtatttgggagcaaatccttcttattatataataacagttcaaaatctagccgagagacacctaacagaggaagtctatctttcaataattaatatagtctttcaccaaaaaaaaaaaaaaaaaaaaaaaccgacccttcgattttggcttctaacaaatatgacccaagatgacaaaagagatatgttgacctcagtgaacaagcttagccattcttgaaaagaaatcattagaaattttgaatgcagtaattcattataaaatgtctgtggtaggcagaatactgcccctccccaccggctaagatgtttgtatcctaatctccagaacctgtaaggcaaaaaggactttacagatgtaattaaattaaatagatggtgagattagcctggattatctaggtgggctcaatgtaagcacaagagccctcataagggaaagagggaggcaggacagtcagagaagatgtgatgacagacacagaagctagactgatgcgattgctggctttgaagctggaggaaggggccatgagccaaggaatgcaggtggccttgagaaactggaaaagacaaggaacagtctctcctggagcctccaggaatagaattcagccctgatgaaaccttaagtttagcccaatgagactctgaccaccagacctgtaagatactaaatttgtatatttaagccattaaatacatggtactttgttatagcagcaatagaaaactagtacaatggctgtctacgagcacagcaccatcatggggaaaatccaacaggattattgtgttttgtgaagccaggaaagggaagccatttcttaatttttataaccataattggtattttaaaccatagagacctcatacaatacaatgatgcaccatttcgccctaataatagcttaaatgtatatagcttttaggtgtcagacactaaactaagggttttaaatgtgataattcatttaattatcacaacaatatgattaaaatgccttcattatcctcccgttgctgacgagggaataatttcaagctcacacatggctaagaaacggcagcactatgcttcaaatccaggcaatctggctccacaatccaaatacatgctacccagaggagatctatgaagttcacgtgtggaatgtttaaaaagcaaagccctggacttctacacccaaagaagatacttgaccataagtactgtggcatctgtgtttccaagtgcaaggatatctgctgtttttgccacacaacatgcttgccacctcacattgacagtagcaccttaagtttcccttggtcaacccttttccacattgcatacagtctccatgggactgtcaatcaagatgtcccacccttcacctggccaatgcaatacaaaccagaccaaggcaattcccacccgccacatctagaaattgaatcttggattctccttaattcctgctacccgatccctggagggtccccggttcctgtattttctaatgcctacttgttcagctttttctctgacttcatgggcaatttcatatccttccaataaagccctttttcatataaatgtatacaagtatgttactttcttcacacacacacacaaaacataaagttggcattcaagagtcttatttgctgagaacccaaactggatgttgcctttcccaccacatgaaaagaggctggagcattcattttataggcctagaagaggcagaacgcaggaaactgattagataatagacagagctcatagtgaaggaggctgaagactgcagggccatgcaaataaaatgaagctgcagttcaatgatcagtcaggagcagtttggaaagtagacgatttttccttagtaattactgttgcatagactatgtatctagagtaaactacgagcaatgattcaaccatcccagcatccactagtatgacaacaaacagtaagggatgcattgaacctagataatgcaagcagtgaagtgagcattttgctggcataatgaatgcttttattgtcttcatgcactgctgtaggtagctatctcaatccattggatactgttattgaccatcgtagccaagatgctgttgacagaattgacaaatcaaagattacttccaacagaatatgaccttaatagggcttatttaccttacacgtacatataaaagtaagacatgaataaaacttattttggatttcctaagcttctgcaagcctatgcattgttgcaatttaaaaatgttacattgagataaattttccctctgcagttacctattacatgtacagctaaaaaggcacagcctccaatctcaccgtgttaagattaaaaactttgagatgataagcagcttcgctgacctgattttaacaggtgctaaagtcactttcacttgtcagaacttttttaattacaaaaagctacatttttccaataaatgaaatgtcaaacgctttgagattgcctgaggcagactttttaaagtgttgtgggtattttttttaactttccattcgtgactgattcaggcacattaaagtccttatgtatattgtcatcacctcctcatctttttcaacaattttgtcctagattcaacctatggaagacaggttttactgtcactctttaagaatgtcactaagaagtcactctacttttctgagatagctaactccatgctgggtagatcttatgaaaaattctccagttcagtcttttgactgaatatgatacatttctaaggacattaagagaacaagagcaaattaagaatgtattcagatttcagtgtattttgttttattatgaaactatattacagttgacctggactcataagtcaccagggcagacttctaatcacagcatacccactaattagctatgcctctgggatagattgcaaaaaatgtccccagcccttcccctttctctgttgtagcttccttcatcaaaagatggagtttatttcctcattcttagaatagtagccattcttgtgatttgctttggccactataatgctgctgtgatgttgtgtgagttctaagtctaggccttgcagcttccacactcgttgctcttgggacccaacaccactatgtgaatagacctgagcttgcctgctggagtttatgaagccatgtgccaagatgatctagctgtcccaatcatcccagccaaggccccaaacatagaagtgaacccagtcaggatcagctgaacctggttcagactataaggacggccatcagaattatgagctaaatcaatagttgctattttaagacactaagttttggggtgttatgcagcaaaaggtaactgacatggtagcacataagctctctgggttctgtaaaatgaggggattgaagtagcactacaattctctcattgtaaaaacattctcaataatatatgtgtgatatggtttggctttgtgtctccacccaaatctcattttgaattgtaatccccacatgttgaggaaggggcctgtaatccctacatgtcaagggagggaggtgattggataatggagatggtcttccccattctgttctcatgatagtgagttcttgtgagatctgatggcttttataagtgtttggacattcctcctctgctcttctctctcctgccactttgtgaagaaggtgcttgcttcccctttgccttctgccatgactgtaagtttcctgaggcctccccaggcatgtaaaactgtgagtcaattaaacttctttccttataaattacctagtctcaggcagttctttatagcagtgtgaaaatagactaatacagtgtaccaccctgtttactcctgagcactcaagttgtaggaagctaaaatgggatccacatgattatatgcaaggattcaaggtgtatagtgtaatacataaaaatgcttgtaaacattaaagcattatacaaagttaagctgtaattgtaattacacacaaattgggaatacaaagttagtctaaggaaaataaatgaagaccagggcaagactgcggagggatgctccatctcctaggcaggctgagaaatggcgaagaaagaactaatagttactgagcacaggcaacgttcccagttatttatgtactatgcattagctcatttcaccctcaaaacgatcctgaaaagtagttattatcaatccctcttacaaggaaggtaaataaggcttgcagatggtaaataatttgcctaagttcaaacaaaataagatataataaccagggtatgcacacaggcctttggactttaaagcctaagatatttctttcctatcactaccttagttgttgacatgccacccagcagagtcaactgaaattagttatcattaaacatttttctttttatttctcatattttcgtcttacgacagaaagatatgcctatgggaaacactggcattaaagtattatccatgcatgcaagatcctattgtctcaaaactactactgttaaatattgggacatattttcccatttactttctctatactgggttttcttaagtaaaaaagcattttaattattatttttaaaatcatgtcaataatatatgaacaagtgtttattataaaaaattaagcaatctagttcaagaccagcccagttaacatacagagatcctgtctctacaaaaagtaaaaataaattagcagggtatggtggcaggcacctgtagtcccagcaactgggaaggctgaggcaggaggatagtttgagctgaagagttcaaggttgcactccagcctgggtgacagagcgagatcctatctcagacaaaaaaaaaaaaaaaaaaaaatttaagcaaccaaaaaaatttgtaagacttttttttaaagtatcagtttggtgtgtacccttgcaaacatattacaaaaaagattgtactgtattgtatcttacttacatgcagacttttttgttttacgtaaatggggtaagtctagctatatttgttgcaaatttctttcacttagcaatatgccttggagatctttctacattaggacatgtagatctgccacattttttaaaatatgcaaaaggtgcatgtaccatattttatttaacccttctcttatccatgtgcatttaggttgtttccaatatgttgctacaacaacgtaattttgaacatcctttcttttaaaaatactgcaacaaatgtaattatacatatagcattgtaaacatgaaagaatttctatttatagatgaaaacacagatttaatttgcaaaaatactgccacatttaccctctaggagaccaattccaaacaggatataaatgcccatttctaccacactagtgaataccagatattatatatttaaaaaattagtcctaacttgattagagaaaaacagaccgttattccataatttacattttcctgattttcaaacaagcattagtttgtatgtttattggacatttgagtttcttcttcaataaattattaatgtatttcctgtgttcaattttaattgtttttcttttgctttggaaaccagatattttatatatatatataaaatggacatataattatatataatatagatattgatactttgatatacatataaaatattctcccagtttgtcacttatctttatggtatgtgcaaaaatgttaaatttgcatgtattcagatgtctattttttatggcttctatgcttttaaaaacgacttcccccactctgtgattgtgtgtgtgtgtgtgtgtgtgtgtgtgtgtgtgtgtacttctagtacttcctaaggtttttttaacatttaggtatttaattcaactggaatatatttttgtatttgatgtacagaatggggctgacttttaacccaatggatcgccagtttccacaacaccatcttctatcacccaccatgttctatgccaatgtattttttaattgatacataatattttacatatttagggagagggtacatgtaagtacttgttacatgcatagaatgtgtaatgaccaagtcaggatatctgaggtattcatccccttgagtatttattatatctatgtgttgggaacattttgagtcctcttttctagccaccttgaaatatacaacacattgttgctgactataggcaccctactctactacagaacactagaacttatatcttctatctaactgtatgtttgaacctattgaccaacctctcttcatcctccccctcaaccacacaccctacctgaatgccaaagtatttttattattttagctttagtccattctcacattgctataaggaaataccaaggctgggtaatttataaagaaaagagatttaattgactcacagttccacatggctggggaggcctcaggaaacttacaatcatggaggaaggcacctgttcacagggtggcagaagagataatgaatgccagcaggggaaatgccagatgcttataaaaccatcagatctcttgagaactcattcactatcacgacaacagcatggtggaaactacccccatgattaaattacctcctcccgggtccctcccaccacatgtgaggattatgggggttacagttcaagatgagatttgggtggggacacagtcaaaccatatcagctttatagcatgttttttgtctggtagagcaagtccccatcactatttctatttttcaaaaatgtctttattattcttgtatattatctatatctaaattttattaaatttggagtcactttatcaagattctaattggcattgcattaaatttagagattaactctggggggaaatgatagctttatgtgacaggcagattaatgttcccctccctaaagaatccatgtcctgaaacctgtgaatattttatgttgcatggcaaagggaaattaaagttgcatatgaaattaaggttgctaatcagctgactttaaaatagattattctaaattgtctgggtgggcccaatgtaatcataagggtccttaaaaatggaagagggaagtggaagaatagagtcagagggagataacgactatgggaaaagggtcgagagatgcaatgttgctgaccttgaagttggaggaagaagaccgtgaaccaaggaatgcagtggcttataaaagctggagaaagcaaggaaatcaattctctcctagagcctccaggagggaatgcagccctgctgacactttgatttcagcccagagaactactagctggcagagatgtaagataataaatttgtgattttattttattattttattttacttaagtgctggggtacatgtgcaggtttgttacataggtaaacatgtgccatggtggtttgctgcacctatcaacccatcacctaggtattcagcccagcatgcattagctattcatcctgatgctctccctcccccacaccctgacaggccccaatgtgtgttgttcccctcactgtgtccatgcgttctcattgttcagcttccacttctaagtgagaacatgtggtatttagttttctgttcctgcattagtttgctgaaggtaatgacttccagctccatccatgtttctgcaaaggacatgatctcactcctctttatggctgtatagtattccctggtttatacgtatcacattttctttatccagtctatcattgaggggcatttgggttaattttatgtctttgctattgtgaatagtgctgcaatgaacatacatgggcatgtatctttataatataatgatttctattcctttgagtatatacccagtaatgggattgctgggtcaaatggcatttctggttctaggtctttgaggaatcaccacgctgtcttccacagtggttgaaataatttacattttttacagcagcaatagaaaactaatacactctacaatattgaaatttctgtaacagttgggatatttagttgcaagcagcagaaatagaccacggctagcttaaatacaagagaaatttattgtgataatattagagattgtataaatatcaaaatctttggaaattaggatctggaagtgaagcaagaaccaagggaggccagacggcaagatgcataaccagagttttgacatcagtcagtgttcaattgaaaaatcagaaaccactttagatattcaagcaaagggaatttaacataaggaattgattaaatggatgttggaagtgctgaaagagcaaaatgcaaaggcggggccaaagaaaaagtgagcagaaggaacaactatggataggagttactcagggatgagtatgatactaccgctcctgagctggagaccatgagactgcactcaccattgagcttctgaagacaccactattgctaccactactgttgaaactgaaccatttctgctgagcaggaaaccaggatcccatatctcacaaatgatgctagagcccagagcattctagttaccttcaattaatttctctgatggtgctgttgccagagacttcctccaaaagtggggggaaagatttatcctttgccttaaagtcttccttcattactttctattggcagaatctagcagaaagccagctactaagggagtttgggggacgtagtttgcagggttttaccaccagcaattcataagtgagaccaagatttgagtacagaggtgagagacaccaggcatcatttggcacagaaagagtatgtttggcatgttagttttccactgctatgtaacaaattatcacaaatgtagcagcttacaacaacctacatttattatctcatagtttccgtgactcaggagactgggcatggcctaactcggtcctctgctcagggtagaggtagagcacaactgggttttctgctcaaagtcttgatcaggactctgatcaagatgccagccagggctgctgtctcattgggtctccagatccttgaccaaactcacatgcttgctgacagaattaagtgccttgtgattgtaggactgagagccatactttccttctggctgttggccaggggctattattacctcctagaagttgcccacagtttcttgccatgtggccctctcaagatatagcagctcacttcttcaaggcagcaggaggatctctttctccagtccactgagacagagttttatataatgtcacataatcaagggaatgactatcccatcacattcaccatattctatcggctaggagcaagtcacagcttccacccacactcaaaagaaagggattccttaagggtgtgtctaccatagttagcagatagatgctgatatcagcaccacacaacactggttctggactcttatgactgccataggtatgaataatttctaaatttccctgtatcttgacccctcactccttcaagattcaaggagtgtagcattcattggctgaactcttgtcatgtgctcgctcattcccttcctagatagcaaagaaagggagaatttccctcttttattttcttttttataaatttattttttatttataattgatatacaattgttgtacatatttatagagcacaacatgatgctttgatacatgtatgcattgtgtaatgatcaaatcagggtaattagcatatttatcaccttaaacatttattatttctttgtgatgagaacattcaaaaacctgtcttctagctatttttgacatatacaatacaatattgtttactcttgttatcctcctatgcaagagaccatcggaacttattgcaacaactgtagctttgtacccattgacaaacctctcaccattttcctcttccccctacactccccatcctctgataacaactgttcaactctctacttccaggagaacaacttttcagaatccacataagagtgagatcatgtggtatttgtctttctgtgccaggcttatttcacttaacataatgtcttccaggttcatccatgttgccacaaatgacaacgtttcattcctttttaagactaaatagttgtgtatatgtaccgcattttctttatccattcatctgttaatggacacttaggttgattccatatcttggctagtgtgactagtgctgcaacggacatgggtgtgcagacatctctaggacatactgatttcatttcctttggttatatacccaggagtgggattgctggatcatatggtagttcttttcttgttgttttattttatttttaatactgattgtagattttcatggggtttagcgtgatgttttgatgcatgtatacattgtgtaaagatcaaatcagagtatttagcatatccatcacctcagacgcttataattttctctgtggtgaggacattcaaaatcctcttttctagctatgttgaaatatacaatgtaatattgttagctatagtcaccctcctttctttttcatagtggttgcaccaatgttactcaaaatagatccctcccaaatagaatgttttattggatgttcacttgttatatctctccatttattcaggtcttcttcctgaacgtgatgtaaagtgttgtggtttttttccatagaagacttggatgtttttgttaggtttctattattagtcaagaatctcaattgcaggtgacacaaaccataacaaatgagctagaagaaaaaaataagatatattggctcagatattgagaatactagagatgcagctaatttagaaaccccaaaaaaatcctttcttctctctctctctctttctctttctctctctctcccacctccccaccctgcccttacttatgatctcatagtttatttttattttattttattttattttattttattttattttattttattttattttattttattttttgagacagagtcttactctgtcctccaggctggagtgcagtggcactatctcagctcactgcaacctctgcctcccgggttcaagcgattctcctgcctcagccacccaagtagctgggattacaggcatgtgccaccacacctggctaatttttgtatttttagtagagatgaggttttgccatgttggccaggctggtctcaaactcctggcctcaaagtgatgcacctgcctcagcctcccaaagtgctgggattacaggtgtgagccaccacgcccggcctcatagtttatcttttacctgcaatccctccaatagcaaaagacctttgtttgtgagatagggaaatgtgtgacttatctgcgcaaagatagtaggtattaaattcacaacccaaaaacctgaatgcataaacatttaactttcaaatctgatgtttaaatatttcattggaagttagaaaactcataaattaattatgagacaacttttatcatttaatcaccatagaaatccttaaaataacgtgctttatatatgttacttaaaatcattaaactttcaaagaaccttaaaaagtataactttcctcctttctctttaactgtacttaatttagctattaagctcacaaggtagtcagcagtataaaacttaattttgccaattcaaggtaactcagccatttctagcttgaaacttagagtcttttgagtaacttaatattcctaacctcttcttctccccaggaatgagctagtttccttctgggtggcttactacagatcagacttcagtatggaaaagcatacatgcaagcctcgtcttttaccagagtttattgaaatttaactcgcttatctggtctttgtcattgagttctggcatttatttcctttggttatatactcagtagtgggattgctggatcatatggtggttcttttgttgttgttttattttatttttaatactaattgtagattttcatggggtagagtgtgatgttttgatagaaacaaagtccactttgtttctgaagtccataatcccattgtggcctgtggccaccaggacacaactctgattcttcttcatcctgacaccaggcaccgtcaggtccactggtgctatcttagactctcagaggtttaggatcactcggctactttccccacaccaggctaatgtgcatgaggccctgtgaggctgacatcaggtagatctgcttggcgacctctcggtctcagtgtcctctgttctggtgccttgctaaatgagaggcttctcttagaggctttcagtctcctggctacagtggagatgtatggtgcaattccttccactctcagatcccctaaaacccatctgagtctcgcatcaccgcctctcactccagacccattccagagaatgggggctgagtccccgtactctgagggacactcactgatctcagatgttctcattttcctctccaaatctgaactcttcctctccttaatggagtcatcacctggtatggggcaggaattacttttacatcactgcgcattcatactcactttgttgtttatggctaaatctcatgttctacttcacttaagaatttgtaaagggtgtgaaacgtaaaaaaaatgctctttgaaaattctaaacttctttaaaaatataaggtggcatttcaactaatgtcctcataatggataatgcctgcttagtttgaacttaatatttctttaaacttgggagagggggtagggaaaaataaagcagtccacagttgattatcttaaaatctgaatttacaaagttgtttggacatgctattctttaacaaaatacgctatctctctagagcatgattcccttttgcagaaatttgcattagccatgatagcagttgatttttcttctaggcatcaaaactagttttaggctttatttttcttgctcattgtgtcatatgcaattaattttaagatgactccctcaaaatacattgaccacactattcatatattcaggttagcccagtcaacggtatagaattaaaatggtgaagaaaatgtgtgacatttaacttgaaatcagaaatatggtgtccaagaagtatcagagaattctacacatcaagggacattttcataatcttttctcattcttgatcatgcgtcaggccattcttagggcagttgaaccacaatgcttgatattttgtgcttccttcttgtactttaaacaattttagcctgatataatctgatttttaaaaattagatgcagccttaaaggaaaaaaatatgttaccttgaagagagtatatggaagggagaggggcttgttgcatctacctattttactttgacgatggtaccctgtaataatagtaatattattgatcacttattgtaggctaggcactgtgctagaccttgcacttacactatctgatttaatcatcaccaaaactccatgaggtagacactctcgtgagctccattttataaatgagaaaactaagacccagaggatttaagtgacttgctcatgatcatcacacagatggaatattgggataatgaaagcacataactcataaggttggtggaccatgaaataaaatattagaatattgtagaagcttaataaatattagccatcaggatgagaaagaaaaagagaagagagctaatctgcaatgagagaaagtccagtcaatgcacagagaaacgtgaagataaaattcagggagagaagaagaaatattggcaatcacacctctggttccaaatattcctgagacccaggtacatcctggaactatgtgagccaataaatgctcctttctgattgagctatactttgagtaggtgtctgaagttcgcaaccaaatccaaactgtgccttccccttcctgctttcctacctgagtgtaagctcaattccaaagaccatagaaatggctcgctcaggcccgacgccatggctcatgcctgtaatcccagcactttgggaggccgaggcgggcagatcacttgaggtcaggagtttgagaccagcctggccaacatggtgaaaccctgtctctactaaaaatacaaaaactagctgggtgtggtgacacacgcctgtaatcctagctactcaggaagctgaggcaggggaatcacttgagcccgggaggcggaggttgcagtaagccgaaattgtgccactgtactccagtctgggcaacagagtgagactccatctcagaaaaaggaaaaaaaatgggtcactcgtttaggattgaaatagaagaagctcattaaatgggtaagaaacaaatatatctttaaacccctaagtttacttttggtattaacttggtaattataggcaagaaacttagtctttgtagaggatacatcattgtaaaaacctatttgcataaaccaaaactgggcaaaatagatgtctgagcttgggttttcctaaaagcagaccctatgacaaggattttgatattagttgtttatgtggaaggtggtcccaggaagcacatgtgaggaattgggaaaagtgcgaaaagaaagagaaaaaagcctacaaaatatgtgttcataataaggttgtcactgtaggcaattagggctcagtcctgctgagaattatctgagatatgtatggaatgcccctcaaaattgccccagtggaggttgaggatgctgaggaatttatccagcaactcttctcatcccttgcttgagagttgtcgccagggccataaactactctgcagaagttgcgcctacaggaagctgagcaagcttttgcagtgccagagaaagcccttggcataagagtagagatacccagatactttgcagtgggaagttgctagcttgctgggagtgtccatagcttcaagtgacccaggcaagccaaaaagatctggaacagaatatgaatggtatctattattttagataccctctcttccctaatggctcctggaactgtttcagtgtcaccaaggaaagctctttcatcacttccaaatttaattttccacatttacttatctttctcaataactcaggaaggccaccgttaacccccacccccatgattttctccaggtagacaccacatctgaattagtagaaaagtatatttctttacatttaaggtcttctggaggaaatttgagtttatgccttgaaaacttaaatttctatttccagccatgttggagtaagtggggcttaacatattctcccaccataaataattacaaaactgctcaaagtatatgagacaatttttagacattggacaacaggcagtacaggaccataaggacgtaaggaaaacaaacaaatgaggtgagttatacaatcaccccagttttctgcttagaggcaatttccaaaccttgaatcccaagcagagcaaggagatgttgatgaattgaagagatggctatcagtgctcaggaagacttagatggctggaatttacagggtaaagtaccagggaggagggagatatgcagagaaatcaatccaaaaataaacatagagattcccttgagtctgttgctgaatactaagctgcacgtgcatagagtgaacatgcttgatgttgggcaaaagataaattggagctgtaatctgaacaattcccagagaccacacaggactgtgcattggttgagttctgactaatcagagaagaaatttcatgctgaacatccaggccttcagtgaagagctcagaggatcactctttaggagagaagctaaactagccctagaataaaggctaatctaaacacacccttaaaaagctagaagaatgggaagttattgtgtgatgggtacagagtttttgattgagacaataaaaaagttctggaaatggatagtggtgatggttgcacaacattgtgaatgtactcaatgccactgaatcgtagacttaaaagtagttaaatgggtaaattttatgttatgtatattttgccacaataaaaaaaaagtatcagagagaaaatgagagacatggaaaatacattgagaaattatacaatacatccgatagggttacagaagaagaaaaaggggaaataacaaaaagtaatactcaaagaaataatgtttttcctgtattaaagaattaataattaataattgtcctgtattaaagaattctcttcattttttaaagtacatcttaagcaccaagctcaataaatataaatccacagatatattgtgcttaaaactgcaaaacatcaaaaactaaaagaaaatcttggttcttactctcctactcaagtaaagctagatgctgtagcagacaacactcacatctcaatggcttcacaaaataaaaggtatatttcttgttcatttcacagagctgttgagtacttaagaaaagacttccatatgacctttcaaagacccagcctctttctatttttcagtccttgtgatccttgcggtcttccactggaatcactacatctagccagaaaacaaaggaagacagtgtgtgggtaagacacacacaccaggaatatgcacacaatggaatactagtcagctataaaaggaatgaaattatgtcttttgcagcaacatagatagaactagaagtcactatcataagtaaaacaagccaggcatggaaacacaaatattatatgttctcactcataagattgtttagtggatgcaaaaaatgtgttcacgtagatgtagagagtggaaagatagatagacgaaaagagactcagaagagtgggaggcagtaggatgatgagagatcggtaaatgggtacaatgtacattatctggatgatggatatgctaaaaaccctgacttgaccactacacaatctatgcatgtaacaaaattgcatatgtaccccataaatttgtacaaataaaatgggaaaacaaaaacacaacagctctcaactgctttatatcagaagtaacacattactgccatttatgttacactggcatcaatagttgaataaataaatgatttatggtacatcaaaaaagtagaatatggtttaaatacttaaattacccaaagctattcatatatatgtgtgcacatataaatcttaaaaacacaatagaaaaaaggaagttgcaggacatgtattttataatgatatttcgataaagcttttaaaatgcaaaaactatcaaatattatatacatataatatgcataatacatttatgtacatacatgtggggagtggtattattatatacatattgaatatatgattatggcaaatctaacattttggcaagttcaggaaagcggtgaactttaggagggagagagaggaatcagttggagaggggtcaatacagagggctttgtctatctctgaaatgttttattacttaaaacataactagcaaatatggcaaaatgttaacatttgataaagacaagtattaggtacacaagtatttctcattttatttttcatatctttgtgtgtttgcaatattttataaactatttctagcacctagcaatcagttaatatttcctactataaatttccagacatgttctatgcatatatatgcaaatgtataagttcatgctttaaacaatattgagctcatagaattcatagtactttgttacatgatattttcactcaatagtatatcttcttcattaataactatatatttaaaatattttaatgacataatatttcattatacattcatgctataatttttaaccacttatgtattgtcatatatttcattgtttcaagtagtatattgtcataatcaaaactacaataaatattattttacggatgcctttcaattatatgattatattcttccaaaaaaattcctgaaagtgaagatgcttggataaaaaccatacgctttttaaagttttgatacatattgacaagttggccttttaaaaaatgtattcaattttagttttaagtgtgtccaagattgtggggttttttttcatattttagtctttaccagttttaatcatctttatttgtggatctttgaaaacctaaacatcacaattgacagagggcagccaaggctggttctccataagcagttgtactaagagagctgtatttgcttaaatgtaaattttctcaacaaacaatatacaattataatttgtatattgatgagtgttaggaaatgtgacaaatgttgggagaatactatttatacccttgaggtcagtgctatacgttatattatagatattttgtactctgtagaaagtgtacagttttacttcacttcaactgttaacttgtcgtaaagtctatttaccctaattggatggggatattaaaaggctgggaaaaataatcgagagcaagggttttctttatgaaatttcattggcaatttcctgctctttcctgaaattgccctgaatacccaaagagaggagcttcccctttcatttctaacaacagaccattaaaatcgtgtttcaggtgttggtaaatgtgggccttgcccttccagtttctggtttgacaagcatcgttgggatgcaacaaaacaaaacaaaacataaccttaactaggataatgtggtgtcatgtgaaaagacatacagaagaggtcaccttggaggaggttattaaaggtaactcttattacaaacttattgcataagaaatgcttaactaaagtaataagttttaaaatactttaagttaaaaaaaatgcatatgtaaaaaacctgtccttgttacattgcacaattgacccaagttaggcctctgtaggcactaatgaacatagtttagaggacactgtgaatccatattttgaatctggcgaatgagattgaagcaacgtgcccagatttcagctgacacccagaaagtttcctttactcacctttcataatccaaagcaacggcttataattttattaagcctcttaaattgcattcctgatcaggctttcacgtagtatcattatttttatggacatttctctaattcccaaactgcagtcctattggtctgtagcccaaattacagacctattggtctgctgatcactgaatttaaatttggtgtttgctcctacttgaaaaactgtatgtgtcagattgtgcagacaatatttcacatgggcatgagcggccactgatatactcatttataatttttgccaataatctattaagaaatatgagtcaattgcaggtctaattgaattgactgctccttaaccattcactgacaggtaagaataacaattctgtgatctcaatatggactactgattattcatacttactagacccatagcctcagcactattgtgagacttggggtctgtcctaatggccccctaacagataaatcaaaaaaaatttttaaattttagatacaggctccggctttgttgtccagcctggtcctgaactcctgagttcaaaggatcctcctatctcagcctcccaagtaggtgagactacaggcatgagccactgcccccggccaatcaatgatgggatttttttttttttggcttaaaacaacacaaatatattctcttaaaggtctggaggtcagacaatcaatggtttaaagtgatgtaatataagactgcattctacctcccttcccttgctttgtgtcttgactatttgcaaaccttttagataacttagaatcataccgtctcactttaactcccattgtagaatagaaagatcagtatgtttttttattgacatgaactggcagcaatatcaataggcagttctgttatctaattatcagaaatacagtaaatacttcttaagatcaattactctaaaacaccacaattattttgggcaaataatcctatatcatgattaggattggctgtgagtgacaaaaccccaaagtaacattagcttaaaaccaattgaagtttatttctctttcacgtaagtggagtcctaagcaatcttgagctggcagggagaccattatcagggacctgtgctctgtgtaatttgctgtttgaccattcttaaaacacgctaccacatttatggttcaagacagttgcttcggcttcagtcttcacatccactttccaggcagcagaagaattgaaggcatttactctcccctttacaatggcacttaaacttgtagtctgttgaccagaacttagtcaaaagttcacctaactgcaaatgaggctgagaaatttagtctttatttcagacatccatgtgcctccctaaaatttgttgtaggttctattagtaaacaggaagtagagagtagatatcaatgtgcagtcatgtgacattttcatcaatgatgagccatatatactacagtagtcccatcagattataatggagctgagaaattcctatcacctggtgacttcttagctttcataacacattgctcacgtgtttgtggtgacgctgctgtaagcaaacctactgcgtaccagtcttataaaagcatagcacatacaatggcgtacaatacgtaacacttgataatgataataaatgactatgtaactgggttatgtgtttactatactatactttttattgttattttgcagtgtactctttctacttgtgaaaaaaatagttaactgtaaaacagcctcaggcaagtccttcaggaggtagtacagaagaaggcattgtaaatataggggatgacagctccctgcatgttaattgcctctgaagaacttccggtgggacaagatgtgaaggtggaagagagtgatattaattatcctgaccctgtgtaggcctaggctaacgtatgtgctctgtcttggtctttaacaaaaaagtttaagaagtaaaaaataaaaaaatttaaaatagaaatagcttgtagaataagggtataaaggaagaaaatatttttgcagaactatacagtgtgtttgtattttaagctaagtgttttacaaaagagtcaaaaagtttttaaaaattaagtttataaagtaaaaaatgttttataaatttagtgtagcgtaagtgtgcagtgtttataaagtctgtagtcgtgtacagtgatgtcctaaaacttcacatttcctcaccactcactcactgtctcactcagagcaactccagtcctgctagctccattcatggtaagtgtcctatacaggtgtactattttttatcttttatactgtatttctactataccttttctgtgtttagatatgtttagatacacaaacacttaccattgtgttataactgactacggtattcagtacagtcacatgccatggaggtgtgtagcctgtgagcaataggctataccatataacctaggtgtgtagtaggctgtaccatctgggtttgtgtaagtacactaattaccttacaacacatttatcagaatatgtccacattgttaagtgacacatgactgtataatcttcaaatacacacacacacacacacacacacacacacacaccctctctaagaaagataaatccaaagtcctatctggttattgcatccacctcatagtcttggggatcatatctgtcttggtataaattccatactatatctttttccaccaccaacacctccaatgccatcgggtctactggatctgtagggctgattgcactatagcctggacttgctacatagccctttgaggctctagattcactcagagttggtagtgttttgtgtcacccagtacatgcctaaaatgctattcctagggatggaaggtattgtctccagaacccaaagagattaccaggtgttatgattccttctttgtgggagggatataagatgcaacaattagtttactttacagaggatgtctcagtgtgcccaagcactggacccttaaaaattttactgaagtataagattccagctggccacctcttcctcacttttctcaaccagcataatgtcatcaatataatgggtcaatgtgatattctgtgggactgcccagatctctttggtctatgttatgacaaaggacagacaagttaagaaagccttgtggcaaaactgtgactgcatagtttgtccattccagataaatgagaactgtttctgatcctctttcctgactgggatagaaaagaaaacacatgccaaatcaatggctgcctatcatttacctgaagccacattaatctgttctaacacggataccatgttcagtctggcagctgtggatgggcttattgcttggaacaatctgtgatcatgccccaggatccattcagtttctgcagaggccacactagcaaataaaataattcatgagatctttttagattcttaagggcagcactaattcttgcaacccccaaggatgtgatattgtttttgagttactaccttggctgcttgggggttggggtaagtgatagagaaagaggtatgtttcatccacttggccttctctactatgatagctgttggccctacacaggccaagtacccaatgtgggggttaaatcaattgccacgtatatccatcccaattatacagagactaggaaaataaccaccaggtgagtccacaaaatcagtaagctagactttggctcccatatgcctccactctaacagggggccatgatgatgcttagtgtgtctagacctcaatgtcaactaagatcctctgtccaatagtcctcaaattgtctgcatatttccctttccccaatgtagcagtcatctaagttaataacagtccctttgggaaaggactggtggaattgtcacactctacactgtcatagtgtttcagcgtccttcctcctggggacctggagacctggttccctgatcatctctttggtcaatgggttttggtcctaaaatctggctcagacccaggaaatgggcaatgtgtcaggactttctattgaatggacactctaagccttctatgcgtgcatttttgcatccttttgattaaccagcatcctggttgtatgcccattggttttgcccttagggagctgtagtttttaaccctcttcacaattctctgctagttaaggccctttggcagtcatttcaatctttctggtcataatgataattgcacccccatggcttctggtgatcaacgccaccaccacctggcctctattgcttttgagtcccatcatccctattgctatcaacaaaccaagttttgtgacagactcgctgatttaacccaggcctgcatgcagcagaagccaccactaaatgtcttaatggtgctgatggatgaccatctcaccagcacatttctgatggccttggcaagtactgtgtcctctgggcataatccactggtggaccttttggccttgcataatatatgcattcctgtctgcccacttatctcagactctttattccttgctctacagtttgttatagcaatttagacacttcaattttgctcagtttaggctgccactttctctggagccacccagcagtgactttaccccatgcccaaggtccttgcctgcgtgtcccaagaaagtaccatcaggtcaataaaccctcccttatccagtcatagttttcagccccattgatcaattaccctcaaaatccagctgattggtaagtatttccacagctcttgtcagtgcatgcttgacaggtcttgcagctcctttggggtaaattctctttcctcccttatcagacccagcacttttccaacggagacataacataatcctagttattgccatggcaatcaggagatacagtggagacagatcctgagagcagcctctatagccttgccaggaagaagatagtgctggtgtatctttctacgctggagggtaagagggagcatgctagcttgtaatagggagaggtgggcccctgtgaaggttctcagggtttaaagagactggggagtcaaaatcatcaagagcatccacccacatgtcctcatcccatgtaccagagtccaagtttgccccaaacagggctccaactttttgtataataaactccctcagctgaacactcaatcatttctgaaggtcaatgaatataactattaattattgagttttgtcctcaggtttttctgctatcccacttctggaggtaagggcctatttgtaaactaccaaagagaacttctggccttcacacctgtttttcaattgtttactaagttccctcagtatttcattatctctctgtagggtgtcattgaatcttaatagcaaccaggcaattccactattcttatatgtattatgactacacacctccacccctacctccccctaccatggaattttcaaatccttgcaccagccagagcatttccctccatcagaatttttttctcaaatcactaccagtggaagttatagcaatcagactgcaagattaggccagggtccatcatacctcccagcatgggttcctcattgccaatcaggtggcgagtgactcagtcaccattccccattgtttctcctgatttctcagaccacttccagtaccgactgcatccgttcaggtcctctgggaagtaaatggtaagatggaatgaggagtgcaaaaagtttattgaggggtttagcagaaaaaaagaagtagaaagcaggataaacatacaaagccttaagatggtgatgcaaatctgacatctatcaaaaaaaaaaaatgagagaggaagtagaaataggcagagaaagcctcagacggcaatgcagatctgacaaaggctcagccaacccagtggggagctctgaaaaaagattgcctgttgatgaagaactatgttcggcagaaatggccacgtcattgtggccacattatgcttgcccaggaagagcagggcctcacaattatgtgctgaggcagatcctgaagacactgcagttgggggctatcagctaactgcactctgcagccgattaacaagtttttttctttaaagaagatgcaaatggcacaccttgtttgccacagcaggcaaaaacaacagatgtccacctcattttcatcagtaatatgaatctcttctatactaaacaagtcacagagacttttattctcatagtttctttttaaagataactgcttcacttacaagctccactgagagaaaagcagataaaaagtataatcactaccatttattaaacatctgctatttttagagatgaaacaaggaggctggcataaattatctttaacctttacactattcattgtccaaggataaccttaatcttcaaggataggccagcccacaccataggcaacactgaatagtacaaaagctgccacattctgtgactcaggttcacatttcatttttgtctcctttctcttagcattttattttttgaactccaaacttgtgtgtgactttggctgacacatgttcttggctttatctctggatttcttctccttttgactcctgtttagatttgctgctcctttttactttgttttctttcaaggtttcccacccccagatatggtgacctaggctctggtgcctgaccctaggacccaaaggtttctactcctagtcatgagtgtaaaagttacccaactccatcttatgtctacccaggggttatctctacttagtctcccattagttggagagtaagaaaagataatcaggcaaggcagatattattatctcaattttatagatgaagaaattgagtctcagagaaattaggtaattgttcaaaagctagtatattgcgtagttagatatttaagatacatatttaaaacttgtgaaataagggaggaaattggattatatgatgttttaatgtcaccctggggtactgacaggattacccaagcattatttaattatcaagggagatgtatctgtgggcaactttgccatttgctattaattaagggctcagactctgtagttatatgttaatttttatgtccagtagaaaatataaccccaaaggaacggtttcattgctgtttggatattaacaagttttgtctctaacttagtacatttatttcaaagtggctttccctgtgactataaatatgccagtagtccaaatgctctttgaaccacccctgggagtgggtacaaatttctaataccttggactgtgagtatcctttgctgagaaatttacttaaaactgatcttgaatttatgaaatttgcaaggccagagcaaagacaaatgttaagccatccaattataacacctcctcaacccaggacacacagaggactctcatggaagttaatttccacagaagagcattctggttaacttaccatcttattgattccctcattcatgaataaaatctctgacatatttccattttaaatttgtatgagagtcatgtttttaacttttgaaaatcactctttggcgctataatgtttgacttcaaagtccttggtcttttcctatagtagattacctttcaagatgagcatgccaatatatatgggaataggaaaagagccgtgctccctgagattaattttctctggaattgggagagaaatcttatgctgtatctctccttatgttaaggctatgcctccatcttggaccatgttttggggaagagttttcctcttgcaaagacttctggtgaaaggaacagctcaggtagattgaccatgaaatctgcctaaaaaattattccagagattgttgaaaccttgaaacaaagcctaagtgcttgaaacagaggctaaaattcttctttgagggctcttttgctttgggaggcctgaatggactctgcataatgtgaaaaattgttttcattgtgggcagggtgacatgctgagagtttacactgctttaactcacagtaattattgttgcctggcaagatgttaaagtcccttttactcctacctcattgaaaggctagataaggctgaggtgggaggactgcttgagcccaggaatttgagaacagcctgggtaacatgataaaactccgtctctctctctctacacacacacacacactatatatatatatatatatatatatatatatatatatatatatatatatatatacacacacacacacacacacatatacatatgtgtatatgtatgtatatatgtatgtatatatacgtgtgtgtatatatatacatgtatatatatacacacacgtatatatacatgtccaaggtattacaaatttgtacccactcccaggcagagatcatattcaggggtccaatttcttgcaggtagctctatttttgccaatggcccagggtgggtacactacttgtgtgtattctacttctactctttgacaaaggatagaaaaaccccttcctagtgcccacatttatttagagaacctaggtgggggtagagagagtgcatgcaggtaattgatccccttcttaggaacacatgtatagggttcttttttccctctgagtctcctctctgctagtcctgggaatactttatatagctttaagcagctattattgatctggtctttttccagatctttctgtgtctaccctgaagccttcaggaccttaggttttgatactcaaactactcaggctcctgcagccccaaaatcttttctttcataaatctaagttccacaaagagcttcaaaagcctattttgtagcgtaaaagtaaatgattctcttttctttctgttcattttaataaggggagggctttgggggtaaaaagtaattaccaataatgaaaaacacattggtttatactgcaaaatactattctgctatatcacatgtataggaaatatggtattgctttattttctataaatcaccttaaattctgttttgggtctccgttcccactgggcagatgatcccaatcattatcagactagctcctctctcattgttatatcagaatccaagagtcttatagaaaaaggggaaagggtcctgtgtagtaaggaatttggccttgctcaaagagtggtctggcctttgtcctggctcttgaaggtaacctctaaagccttggaatttttggagtaatgggactgttgttatccatggtcagccacttggaccacacccaatagctcatgctaaggagatgactcaaggtggggcaagccacactggatagtcttttggtggaggctagacataccagaaaggttaattatgtgatgggggtgggagctggagattgaattcaaccacaactcagtcagcctacacaatgaagccccagtaaaaactctggatataaaagctgaagtgagcttcctgggttgacagtttgcacagaatattgttggcaatcctttgtgggtatcgttacacattgctgtcatgagagtaatgcatcctgagaacaatgggagcttcatgtttggaatccttgggaatccttccacactctgccctgtgcatcttttcctgattttaatatatccacagtagtactatttataatggtcccaaagtggaaacaatgttcatcaaaaatagaatagataagtaaattgtggttgctatggtttgaatgtcccctccaaaacacagattgaaatgtaattgctattataacacaggtgggacttttaagaggtgattaggccatgagggctctgcctttgtaaaccataaagtatctgagacaagtttcaatcaatttagaaggttaagggcacacccatgacacagcctcaggaggtctgagaacatgtgcccaagatggtggggttacagcttgattttatacattttagggagataggagttaatcaatgcatgtatagcgtacattggttttgtctagaaaggtgagataacttgaaggggaggtggggtgggggggggtgagggggttctaggtcataagcagattccaagattttctgattggcaattggttgagttcacctaaaggcctggaatcaataaaaaggaatgtcagggttgtggtaaggggttgtggagaccaaggttcttattatgtagatgaaacctccaggtagcaggcttcagagagagtagatggtaaatgtttcttatcggacttaaagaggtgccagactctcacttaatctctcctgggtcaggaaagacctggaaagggaaggggactctctacagaatgtagatttcccccacaacagacagctttgcagaaccatttttaaatatgtcaaagaaatatatttcagggtaaaatactttgatttctttcagatcctgctatctgtcatgtgatgtatcttattgctacagtctgtttggtcagtcttaagatctctgttttaatgttagtgctggtcagttgtgcctcaattccaaagggaggagggtataatatgcctgaccctcacttcccatcatggcctgaattagattttcaggtttactttggaatgctcttggccaaggaggtgggaggtggtcaattgtagagcttagaattttattttgggtttatactttcatgaatggattactgctgttatcatgggagtgtgctagttatcatgagactgcatttgttacaaaagcaagtttggtctgatttcctttctctgtctcacgtgcttgtttgcccttctgccatgatatgacacagcaagaaggccctcaccagaaacagccccttaatcttggacttccagcctccagaactgtgagccaaatagacttgttttctttataaattatccagtctgtggtaatctattatagtagcagaaaaggattaagagagtgatatggtcatataatgggatatatataacaataagaattgaccaaactagataacatacaacaacatggatgaatctcacaaacataatgttgaatgaaagaaactggaaatgagattataaactgtatgtttccattgaaataaattttaaaaccaggcaaaactaatctaaaatgttttaagtaaggataatggttattcaagggggtggtgactaaaagaatacacaagggggcttcagggatcctgaaaatattctctttcttgatctggatattatttacatgtgtgtttacttggtgaaaatttgtagaactgcacacttatgatgtgtgcatttttaatttgtatgttatatttcaataagaaatttacataaacgtggtattcctctccccacttacctttaagggcacctctcttcaacgagctcagggtttagaaaaaaatccagatgggaaggatctcgtacatgacttctgcttagggcaaccaacttgtcctggcttgcctgggattttcctggcttcagtactgaaagtctcatgtgctaggaactgttcccctctcaaaccccccctacaagtcctgagcaaactgggatagctagttaccctatttctgcctacaaataaaatacaaaccctcctctgggaaggtgcacaaaaagaattactaactttctggaatgaaggaggaaaaaacaagaagaaagaacatacattatgatctcaatatattatcctgccacaatatttatagtgtactcattatcacaatcaacaaaagctctttctgtttgggaaatcaaagacacactatatcactttgaaaagtcagaatctatattaacctaaaagctcaagccacacacgcacacatgcgcatgcacaaccatctgaacctagatccagagggagatactcagttggaaagtttactttctaaaaggtcaaataattctccctgaagttcctgtagacaagtgattttagagatagaggcctctagagatctaaaggaaatgctatgataatacaaataaaccgtcttgcaacccagctgtgacatttgataccagggggaatatgactgaaaatacacagtgccactctggcttttctcaaacgaaaagggaatcgtcagagacaagtataacttgcaaaaacaaataccaaaacatgagaatttccatttatagttcaaaggatgaagatgctaaagggagtggcaatggtgggctgtagaataactaccaaatagaaataaaatattgagctcaatcttggccaaacagttccaaaatggaaagccaaagaggagaagaagacgaccagtttaaattaactccccagtcaataagtctcttaaacaaagtgttgttactttaaagtcttctattacacagtgattaaatgtgctcctactctgattaaaaacattttgtggggcccatttctccaattctagttctatagcacttaatgttccctccaaaattgctttggggaaagcaatctcatgtcagggaaatgaattccaaagtgcttccctacaagggctgagggaaattcacaccttcagtccaccacttggaaaatagcaggctttagattgcttttggaagttcaaaaaataaattcaagaaatctgatgttgagtgaggtaatctttagacagttcacatacacatttagtccttagaactattattaccaatattcttcagcagaatatacttgttatccaaggaactattttaacagtatgttttgtaagcattagcttttataaaatatctccttttcagagatggtaatttaaccttttgcctttccagcttttggtcacactatgtatttaaacaatgaacatgcataacttagatttagctatagactagaaggaccccctatgcagcttctggaacttttctgtcttgctctcttccctccagtcctttccccaatatacatatctccctccactgggcaatccttctggactcatgaccaatgatgtatgttgggacagcttgcttggccttgagtccacttgggaacagacccttcaaagcctctttcacacatggctctgttattctttcctcgaaatggatcctctagcaaaagccatagcttaacacaattccagtgaataccattcacatatatgatagagggatgctactcaactagaggtgtgtgatgtccagactctgtctcacccctcagtccttatttttcttcacctgaaataagtactggtcacttgttcacattccccctaaagctgtggtctccatgctttgtttactgtttaccctgtgaataaaaagatttttgatgacactttccaacatatatgcatacctttatttataaaatatatacatctgcatatacatacacagatacaatgtatacatacatacatattaaaaaacttttaaaagtttgtaatacaaactaaatatgaaaagaacttctaataatttttgagatcatcagattggatgaaaaagcaagacccaaatatgctgcttacaagaaatccactttgaatttaaagatgtaaataaggttaaaaataaaagcatgggaaaatatataccacactaacactagtaaaaataaagctggagtggctatattaacatgaaagtagatttcagagcaaagaatataagggataaagatggtcattccataatgataaaggggtcaattcatgaggagtacatagtaatactaagtatttataaacttaataacagagcttcaaaatacatgaaacaaaaactgatagaactgaaaggtggaatacataattccacatttacagttggagattgaaacaaccctctcaataatcaatccagagtaaacagaaaaaacaagtaaacaaaatcagcaagtatgtaggaaacttgaataatactatgaactaaagtgacctaattaacatttataaaacattctgtgtaccaagagcagaatacacattcttttcaaatacacatggaatatttagcaagatagaccatattctgggccacaaagcaagtctcaatgaatttaaaaggatccaaattttgcgatgtgttctacaaccacagtgaaattaaattagaaaacagtaacagaaagatctctggaaaatcctcaaataacacaactttaaataacttatggatcaaaggagaaattagaatttttaattatataaaaacaaaaatatgacaaatcaaaatttgtgcgatgtacctaaagcagtgcctggaagaaaagttatggcactaaacacctctttgagaaaaaagcaaagatctcaaatcaattatctcagcttgcatgataatctaggaagttaaatgtttctgtatataagccattgggattcctctccctctgaattccctttgtggaggtttttttgctcagaatctttatttatttacttatttatttagagacagggtcttgctctgtcaaccaggctggagtgcagtggcgtgatctcggctcactgatacctctgcctcccaggttcaagcaatcctcgtgcctcagcctcaccccgctaatttttgtgtttagtagagacggggttttaccatgttggccaggctggtctcgaactcctgacctcaagtaatccgtctgccttggcctcccaaagtgctgggattagaggtgtgagccaccatgcccagcctgctcagaatcttactcatgacctctttctgtgactggcgatgacaaatgggccatatttcttcttttcctcactccttattcagctaagaaaaagacctctactcctacttgtaccccttagacacttgagcagaaattaagtttgggctcaggagaaaggacacacaggaaaggccccttaggctagtttccagtctaggcagaaacagtgctcaatgccattagcgatccagtctatgttacctgggccgagatgtccacttggagttttggagggccatcacgatataatcacatcatgctgtctcctctttagacttcaaaagacctaattctcttttgactactttagttaaatatttccagtgtattttagaattattaaaaggaaattcattgatttcaatttattaattcaataaacatttattgagtgtgcaccaagtactattctgggcaccaggtatgtagcagtgaacaaataggcaaaatttcttatatttctattggtataaaaaactatagcaatatgcatttctcgaagtctattggctttgtcccagaacttcttagaatagccattactcccatttttaaataaaattgatatttaatttgtattttgacagtgcaaactaatgaaggtatttttagtgctagaaatgaaggaatctggagtgcatttatcagatgaaatgaacgtcaagaaaatgacataataaataatatgaacatgctgagaagagacggaaaaatctctgtgacaatcgataattttttattctctttaaaggcttattttataatgtaagaaagaaagaaatatcatgaggtatttagaatatgttacaagctccaaatcaacattgaatatttctaaaaggaaacaaaagaatttcagaagtaacttcagcaatccgacaaccatattgaaaaatattataatagtgcatggcttttctcacctttatagcttttaaaatcagcaggtagctgttttgttagactttcaaaattaatttcttttttatttagtttttgacatgaaccagaaagtcaggtttttgctagttatgagataatctttaggcatctataccagtcatatcaaaactagcaaaaatttagccacaattttttgttttggtgaggaggaggctgtctgggtttcctttttacagtgagtcctttcatactgtactgtatggcaatctgagggtgccagctttctatttcattggccccatgccttctgcaagtcaagttgctgactcactttatggaatggaattaagaacctgtccaaatcaataggcatttgtgtgagcatgctagttcttccccaatatccattttctctttcttccatggaaacagaaattttagctaggcacagtattaacaaaggtcagcaagatcttggaagacaactcatgagcatagcaagcaatggcattggggtaaatgataagaaagattccaaatgttgggggaatgtatgctgcatcttagtacttttaacaacatcctatagagtgatggaccctggtgagagtcagacagaaagcaacaaaaaatggagggaacatagctctgtcaagagtatgttctttgcccgtggcctgcaatttcagagtcctacgcaattgaaaaagccatctgctttctgcaacttcacagtaaagcagcttaaagaggctgcagaaaaggaagacttggcaggaaataatattgtggctcctcacacatcttccttttgaccagtaaatgagaaccagagcagaggtagagatcatgttaagtatgtcaacttctcttacaaacctattaagaagaacctaaggaagcaactattaagttcaatgagaggaagatgaatcagcacagagaacagtgacagcaaaagaatttacttggaagagatcttagactatggttacttctatatgtaattggcaagtagcaaatagaccagaatcctattaagtagtagagggaatccaaaagccacagaaaccaaaaggctggtttgcaaatgcctatcatgattagagccctcatgtagtgttaggaccccccacacttctcagtaggaaacaggctgtgaaagctgagcaatccccaagaaccgcccactgcaaatgtggccataataatcaatgaaaatgaaccttccatagagcagagacaaggtccataaaggacaatggacaaggagttttcttaagagagcagagctaagagctgtcagatgggctaactaagaaattcaatccaatgttaggacaaggagcttttgcatttccaagccagtaggacttaataattaccatgaactaataatgactgctgagtggttccccttttccctttccaacatcagtgtttctgttcttattaccttgttcctagtccaccattatgttgtggatggggcacataacttgtcttactttttataaatcacaggatcacaaggagacacatctgagcctgatatagaggattgcacatcagcacatcattcagagatcctggactttgagatgtatgtagtaacaggcgtgtattttggagttttcttcgttggtgacggatgagtttgttctatgtgtggctggaaagtgcaagatcaaagagctgctatttggtgcctggtgagggcctttttgctacgtcctcacatggcagaagagcagaagggcaaaaaggacaaacgttccccactcacatggcagaagagatagataagcaaaagctaggtagttcactacagccctttcataaagttgataatcccattcatgaggggtctgtcttcatgacttaatcacctcctaaaaaccccacttcttaatactaccatattggggtttaagtcccaacatgaattttgaaggggacacaaatattcaaactatagcagtggtacaggcacaagattggagagattggagagcaagagggaagagtttgcggtatttttctccctctttttctgattcttaaatcatctcttccatggatttagcttttgccaaaccaaacctcccttgatggtccaactactactggacaattctgaccaggcagacatagccatgattcaggttccctttaaattgccctggattctgggatctggtaaaaccacctcctccaaataaatattagagtagtttctgtgtttattgctgtaccctctcttaatacacagacaatataaccctcttagaaacaagagcaataatgatagtcatatatgttgactcaattttttaatctgaaaaatgtgtccttggaagataatataaaagaaatataatatttgcataaagatgtcaattttagcatgacatataatagcagaaaattggaaactacttaaatatccagtatttttaaatggcttaaaaaattggtgtgcataccgcaatggaacaatgtagacattataattattaattcagtaagcttttgctagattatgctgcagtaacagatgattcccaaatctcagtgatttatcacagatttatttctcactcacaatacctaccctttgcaggttagctatagctctgcttcatcctaggacccagttggaaagaccagtccccatgttggtctcatggcagtggacaaaaagtagaacagaataacagctcttcaagcttatgttcagaagtggaatatttcatttctggacaaattccactgaccaaagaaagtcatatgaccaagcctgctatcaatgggacagatactattccttcagggaggcccctctccccgaagaggttctatagagatggacccagaggagaagggggcaaatttattgaagaataataaaacctactacattaatgaagactatgaagaaacatggaaaatgtttgatatgaagaaaagtaaagtaagaatctacaaaaagattttacatataccatcatggtgaattctggtaactgttcaccaaaatccattctaacctgcttcctaggtatataaagttagatgtagtcatatgattaaattctagtcaatgagatatgagtagaagggatgtgtgatactccccggccaggtgcctcctttacacatttttggtcatctactagctgatgtccgtttgtggcaatccaacctcaatctcgtaggtaacaaggctatagaagttatagaggcacaaagcaagaggaccctgggtccctagatcaccatgtggagaacacctgacctagactgttatgttagggagaaataattgtgttctttaagtcactaaattttgaggatttctttggggttctattagcctactaactgatacaagtattactgcatttgtaaaagtaaatgatactgtcacttccttcaatttagatgtcattttctccatgaagcctttcatgagtccctcagtccaaattaggtatctctactaggtgctcctcatacctacccttactacactttattgtacttgtttgtgtatccatccctttaaatggaaaactataaccacagatctttgttcactgctatgaccctggcttctcgcataagacataacatcacagagcctccttatatatttgttgaatgaatgaatgagtaaaaaggaaagtcactgttttataataatagaattacaggcaagtgtaatattttaaataattatccactgacttttgactatgtcaatatgctttatttacaattttctaaccaaatatgccaaattaagtattgtcaactattattcttcagcacgtcttttggacattacacacatgaaccataatatgggtttgaaactagcgggtttttttcattttttggaatttcattttgagacagggtcttgctctgtcacccaggctggagtatagcggcatgaccatgactcactatggcctcaacctcccaacctcaagcaatccttccatctcagccacccaaatagctgggaccacaggtaagtgctaccatgcctggctaagtttttaattttttgtagagacaaggtcttgctgtgttgcccaggctggtcttgaactcctggacccaagtgatcctcccatctcagcctcccaaagggttggaattataggtgtgagccaccatgcccagcctgaaactggtttttaacccatctgggtttgaaagatctatgcatgcactttatcggctactccaagactattccttgtctaaggaatatcaagaggactcactctcatgcgccatgatttagcatctcccaactgttctctttcacatctctgagctcacaacagtgagtcagaagattgtagaaaaagaagttagaaagagttcttatggtgtcatcactctctgattgagagcatgagatgtgggagtaagcaaatcatctttttaagtagcaaaaggagacattagctgggcgtggtggctcacgcctgtaatctcagcactttgggaggccgaggagggtggatcacctgaggtcaggtgttcgagaccagcctgaccaacgtggtgaaaccccatctcaactaaaaacacaaaaattagccaggtgtggtggctaacgcctgtaatcccagctactcaggaggcagaagcaggagaatcgcttgaacccgggaggcagaggttgcaatgagctaagatcgagccattacactccagcctgggagacacagcaagactccgtctcaaaaaaaaaaaaagacgttaaaaaattctttatataatttatcctaggcaagatggaaataataataaaccttaattttgaatttaattattttatttataataactggacatatacttactcatttttattatgagtttacacatgacctctttcaggacaactgaagacaactaactctctcccacccataacttttagcaatccccactctcccaaacacttcctccagacccatagcttctagaacaccaaaggcatgagctatggcttcatttgctacattccattatgcttatttgtttatgtgacattctttctaataggctgcaaataccttgaagccatggactttgtcttattcatctcggtgtcctcagaatgtggctcaataaatgtatgttgaatgatgaattaatccctaaggctatgaataaatgacacttactgtttctggtgttcctggcagagagctcattgcatttgggaagggaagggctgaattcccatcttggctgaaccggttacctattaccttgggcaattctcttaacctcaattttcatctgtcaaatgtctctttgtactattacatgtttactatggaaaggaaactctgtggttcaggaaaacctcaagaccatcaggaaaaaaagctactaaaacaagccattttttatgtttattgaagggtagcctatagccttcccaaaagcaaagaacactctcagctacaatattttgtaagcagtattgattcataaatcacttacttttggtggagaggggtttaaatcctgcccctgtccactcactgtgtcaccttaggttctccaggtgtgtttccttttgtagaattacaattaatttaacacatgcttattgagcacttatgtcttgagtatttattacatgttgagccctaagcactaggcaaaaattggattcattttagtgaaacaatataaatatttttggtcactttgccttctgtattagtcaatttctatgctgctaataaagagatacccaagactgagcaatttacaaaagaaagaggtttattggacttactggtccacatggctggggaggcctcacaatcatggtggaaggtaaaaggcacgtctcacatggtggcagcaagagagagaatgagagccaagcaaaacggtttccccttatcacaccatcagatctcgtaagacttactcactatcaggaatacagtatgggggaaaccacccccgtgattcagtgatctcctacggggtccctcccacaacacgtgggaattataggagtacaattcaagatgagatttgggtggggacacagagccaaaccatatcaccttccctatactcagtcatgatcttgagtattcaaaccattcatttcttatgctcattcattcatgatatattcatttagaatcttttctttgcaagtgacagaaaacgtatctcaaacaggcttatgcaaaaggaaaagagatcatgtaactaaatagtctagaagatagggctggttttaagtactgcatgatgcaggagtacaaatgatatcctccaaacctagttcttctgtctctccctttaaccctcagttcactacctttgggttggtgctgttctttagacagagtccccactatagttatgatatagaactaattaataattttatattccctctttcagtgtcttggtataagagggctcaattcagttgtttcttgtgcttatgatagggaaaattagagtaggttgctcttaattcttctagcaagctcagaaggcattctgacacttgttatttaaggtactggccagtacaggcacaagtactaaatgaagattaggtgggaagcagagtagggggtagaatatacagaaaaaaattagattatgagaaacccctttttcattgagaatcactaaatcacaaagtaaaaatcaaggggtctacacagaacattaacataatttaaatagggcattttagtacaaagagcagatttgtctaaatgtgatcctgagaactcatgttgggttacaggcaaaaagctaactggaaccagggatctgcccttttaccaaagggaaaagctgcatccgatttcagcttcccacaggacttctccccctcatagaagaattgtaatatctaattaaccccaaggtcccagacaatgcctataaacagttggcaccacaacttcagattgcctggcatcaagcagcctgagtagtccatcactgacaaggcttctcttagacttgcactataagaagggaaagcaaaggggcaagggatcctctcaacagaacccagtgttacccttcaggcccagcaagggctccctcttaccaaggctcaattagctattactggcccgacctaccagcagcagagatcaacactgagcccacagtacagcaccatttctcaaggagaccagacactttagcagattgattactttggatcccttccacacggggtgtggggcatgcagttcattcttgccagaactgattcatactccaaatatgagtttggcttacctatccgcagtttctgcacgagcaccaccattcaggagtttgcaaatggtcatctagtaacatggtatcccacaaagtattgccttaaaccaatggacccattttactgcaaaggagttgcacatgacagtaagaactgctggtatcatataccttatcctgtagaagcagacagcctcatgaaatggtccatgaaaggcccagctcactttttagcttttagaccataccttgtggagttgggggtgacacagaatgtcgttggtcccatgaatagcctctattctttctaccatgagtgaccccatgtgagaccagaagaaaaactgcctggctgagcccaccccaatttgctgacccacagcataatgagaaaataacatgattattattttagactatgttttgaagtggtttgttacaggacaatggaatattgatacaacaggtgaggctaaaaatatctgaaatggtacataagatgtgtctgatgatacaggtgaaaagaatgcatactaagtactatcacattccaaagagagctcctaggcacttctctacaggactcaccaagaggtgacaaaaccggttctatggcctcactcaaacacttcctccagcctaaataagagaagactacaagggagaggtttattagttattaccttaaagggggtgttgtacattttctctcccattgaaaaaggggaagccaatgagaaaaatgagagtgaggtggcctatgagagctgattaagaatgtcttcaagatatatcaccctccagatgcttggttactgaactgaagctatctgtaggtccaacctggagagaaagttttagagagagcctgctatgtatccctggagtttggaggcccatgtcagtatagacactgagactgcctcttgtcagaattctgaaggcagaaaacttgctggagcagcaatgacaaggcagcatgtctgttgttcagcatggcaaggacttgtgaacttctcatggatcaggtgagtgtctcagaaggcaaaataacttgagccatttgcttgtgcctgccaaagggcttgccagttggtgaagcgatactggcagtaagaaactataggtattccacaagagacaggggctgaggagaagtttaaaaggattgagtccatatttaagaaatgtgcagtgaagggggtcctgaacaatcatactcaccctatgagagccagcattcggatgccagtcacatagaaggcattgacaaccaatagaggacttacagcagcattgaaaagtaagagagacaaagggctgaggagagagaggctagatggaagaaagagcttcatttgtgtcctgagaggtactcctgaatctccccagtgggaccctaagaagaactcacagaagaaatcaacaaagagccaattttcggcatttgccatgtccagagaggacaaagccatcttatgaaaggatcagtaaagcaacaccttgccacctccatttctatcctcttcatccctggaggagatacagctatggttagcaagatagggtaggagaagtagaagcctaagggacggaaagagaagggttacacctgcttccttgactccaagctcctcattggtggtaggatccaactgggagagaggacaagatataacttcaaataaggtctgggttttgataattttatggggcttctggttgtcccctcaatgttttttccaaagtcatggaatgtttagctagttacaggactgcttagaataagaccacatttcacagtctcccttgcaggtagatgcaataacgtgattaagttctggccagtgggttgtgaacataagttgatggtaacaacttctgggtcatgcccttaaaggaaatgggtaggctttcacacccttgatgactgaaatgtgatgtcgtgctgagccattctggaccatgtagactaggacgacagtctaggaatggtggagcaagaagacatagggagactaaaccgtggctcactttgtggaacagagctgccgtattagtccacttttgccacgtaataaggaaaagtctcagtgccatgctacaataagcatttatttctcactcatgggtttgtgagttggctggggctgctctgcttggtccgaaacctgaacttgaagcaggttttctacaaatgtttcagcacgatgggccccagtatgtggggtgtgtgataggagtgaatgaccccctttctgaccacatccagcttccaaaatgagtggctcttgacactggagctgctctacttcaggatgtgggtcaagttcagctccagtccaggtgtcacattctcatccccaggctagagggagattggaagctcccagagggacaggagaacttccttcccatagcagcagttggatcctttgcagtttccccacacttgcagagacaacgtcttgagccccactcaaagacacgagcaccagcagatgctgctcctttctcagaggtctgagttttacctccacaaggcaattcctctaaacgtctaaattgtaataatcccaacctcttcccttcctcctcctagctctaggcatagtagctgcttcctgcagttgctacctctgcgatacattaagagttctctctgaccttatcagttgcctaataatcaattcttgatattaaattctcttggttgaaataattggggtggtttgtttcctgctatcgccctgagtgattcactggactaaatcctatgcctgtcagacaccgctcaagaattttctctttggctgggcgcggtggctcaccacctgtaatcccagcactttgggaggccgaggcgggcagatcacctgaggtcaggagttcaagaccagcctggtcaacaggagaaaccctgtctctaccaaaactaatcagccgggcatggtggcacacacctgtagtcgcagctactcgggaggctgaggcacgagaatcacttgaacctgggaggctgaggttggagtgagccgagatcacaccactgcactccagcctaggcaacagagtgagactcggtctcaaaaaaaaaaaaaggaatttcctctttgatgtattttatatcctccccccatatctgtcactcctctctgtactcatttctatcatagaacttactgtgctaaagtgtcgtcattgttttttctcattcatctccatcccagaccaatagctccctgagatcacagcatttcctcagtagctggcacataggaaactgaacaacacacgtttgaatgaatgagcaagaaaaaataaaataggaaaaagaattattagtatcagatggctcatgtagcactaaaaatgaaagagaaagttagatggtgatgtgggaaacaggaggactgtggctgccaactgtgaggccatctgcaagcacacagcaagaagctcttgattaataatgtgaacccataacaggatgaagaaggtgcagctgaggctttgcacagaatactcggtgacaaaacccataaggacaagcaaagggttagaagactcccggggacgcaaaaagtgtgttggccattcgggctcctgagggatgaccaagccttaagggacgcctctcacttggtgcctggtcctgccaagccctttactgggtttcttgactgggtttcattaccccgccccgcgccactagtggaaacaggtaaaacctggagaactaggtcctactttaggggccgttccgggcatgcgtcattacccgcgcacgcaggcgcagtaacttcttcggtaactggtactgcccatttccgatatgggaagcgtttgctcaggcttccctaacttatcacctttcctttgggcccccgccctcctgttcctgtgggggaagcctcgcgagatcgccctgggcagtacccggcggcgccatctttgtgcctggcgagcgacggcgcccgacggaagccctgaagccagagcttgcttgccaagctctcgctcagaccggatctaggaaatacgaggcgggcctcggtgggagggacgcactgagggaggagggaggaaagggggcggcggcggcggcggcggctcacaccggatcccggccctgcacggcgcgtaccctgggggttcgggcggggaagcggcgccggcccggaccccccgcgggagtaggcgacgggcgtgagggcgaggcggcggcggcggcggccagagagcagcagccgcctggtgagtgtccgcggggaggcccggcacctgcccgagcagggacgtcgggggcgcccccgggatcgtcccagtgaccctgtgcctgagacggtgggcgtgtgcgcaactgcggcgtcccggggactcaccccggcccgggactgcggctgacagcgggaactgcggggctgccggaggtttgcgcagggcctggcgcgtccgcgcccgccccagacgccccgagaggccgaggggagagggagtggctggggtggggtgtcgacttgattggccttggtcccccaaacggaggggacgatgcccttcctcgccggaccctaggcattgcggagagtgagcctctgtggaccggctttaagcccccaggaaggtgtttgaggatgaggactagcagcaccagcgtgggggccgttgagggtgttgagagatgtgaaggttagtagcagtatagtaagaattgttggagaggaggtttccagatgactgttggtaggtgttgagtaaggagaaaacactgctttcctttaaagatcgcacaagcagtcctctgaggtccaacaacagattagagttattcccagttggagttctgtagtttactaccgtgtgccagctcataaagtgcgtaaaagcaggatttgaagggtgagggacaggtgaggcataaagtaagctgcataaaaagatccaaagtttgttaatgtgttaaagtgtaaatccttctgtttctactgaaatgtaacttatttaaattatttaagaaaacttgccacctttggtccagaccgggcttgtcagttcgatgtgtttcttcagtgacgtttgtcaatcaggcagtcattttggcatacagtatatttacttctggtttctaaaagaacaagaatgaatgagaaaagggaacagtttggcaaactgagctttctttgcgcactttttcattttgaaaggataagagaatttacttttttctttgctttagtaatgatttgcagtagtatacaagaacacgtggaagaagaaagggttttttgagatgagagtttaattttgcacagtgttaaattataaagggcctcatcacccatggtaagttttgtgatggtgtgttttatgaacaccggaagaatacaggcacatacatatacatgctttttagtcagtgtgtgatatgaatctttacaaccgtagggacagcccccgcccccacttgcttacaactggcttaatcaagggaaagacttcagtgaaggtaaatattaaatatgtgattttcatcttcacatctgaaagaacataatctgcattcagtcaccctgaattttcatccatatgtttatttgatggagtcttcccctcagttatagataccacattgtgtacagtttgttggagcaaacagagctaacgtcgattatattcaggcactggagatcctcacagctaccctatgctaaagataatgttatgccgattgcacagaacaatactaacctccaatattctttggcgacttcgctgaggagattatatagctggtaaattgcagagctagaactcaaactcatgtaggtctgattctagagtgtgtgttctttcaccatactctgcgtaagtttttgtgctgactgatacaaattttatgaaaatggaaatttgtgttacaaagaaacctttcagttctgttggtaatcttgaaagctttcagtgtccttggctccagataatctcaaggtttttttttcttttcagatgcgtccattttctagccagaggtaacatttgagctagaagtctgctgatctgtaaagagattcctgatagctggtagtgacctatctgaaattcagatattttcagttactttgcctcttgtgtcagcatgcccaagatacttcaaagaacaaatattttgtttattctagtcctgaatagtatttcaaattacattattacatggcaactatctataggggtttgaatttgctttatcagcttggaggtacacatacacatccctgccttctccagcaagtggagtacttgacagctgaccctgtttttcttctctttaataatttgatacaaaggttttggaccctattcatgatttgcagaaaagacggcagctcttctgggatccaccataatctgctatggggcaagggaatgaaagaccttaacaggttcccaggcagtatctgaggtgttgatgaaacagcaggaacatcttgccagtggtcacttttatctcccactggtctttgctgttgcatttcttatgtgctgcagagcctgctcaagagaagggctccacatctgaatagagttgaagtggaacagccacagaaatcagaaaaaaagagaaaaagatactaaatgtctggtagtcatcctccaccaagtcacttagtcaggtttagctgcctagttaattatctctggctgaaagttctagaaaagttttgaaatttggggtttgctgcttcatcttttaagaagtacattgtttgggggccttcagttaagtagtcctgtcttcatggaaacagaaaaaggagtcttgtgttcctcagtacacatcagtatgtgtgtgtattatgtagctttagagactgttttaagtaatcccttggcatcttgatgggcaatctgtggtctgaataagtttttaaatatagttatactcccaagaaagcgttaaataaaatatacttccttacttgtgaaagtaattactcatggtatttgggctatttattagggcaaaaaaaaaaatcaacaaatgataatgtaactgaatgcttaccaagtaaataaagcctttctgaaatgatttatattgccaccgtataaagataaaacaccaggaaattgcctcatatctacttataagtttattttcataccttctatatggtaaacctcaaattattaccatggccacaaatatttatttctctaaaagtgaaatggacttgatgaaatatttggaactatcaaactgaattaatcctaaataagaacatttattatagtttaattcatggacagttctatttgtccaactctaacatcctacttccctccctgcttcaaatttctctactttccatcctctccttctgatgctgttcctaccatttacctggcacccttagttttccattgacactgaagtctttgatagggtggatgctaacaaggaaggcaccaaaactcctccaagtcccttctccaccatcccgtgctctaggaggtcaagagggatgcggataagatctcttaccccaccctgttctttcttgaaaaggaggatgagaatagccaagagtgagggaggcactgtcaagaccctccaatggtttctcctcttcttccctctccttaaacaccaaggaggaaagttggtaaaagcccacgtgctgcaggaacaggcactgtacactcatcctcttcagcaggccgccatcttcgcactgtttcctcactcctttcagctgccatcccccgctccatccttctttcccagttggtcttgccttcctcatccctggatctcctcccaccccagctctgcctttttgccctccttcatagtggaagccgaggtctgtggtcctagggaagctcagacttccagttatgggagggaagatttcctttttctacctccagggctaaatgggtcaggagtagttgctgttatcctaagttggaatgctaaattgattttcctgtagaaacattgcccacacaggttctgtgttttgttatacttctgtaaccttttggacatttaggcttttgtgagcgggcttggaaacctagcatattgatcattgtctcctggaaaggcaaagtctgagtttcaaatagatgattttaaaaatcagcttgtgctccagaaattgttgagggttgcctgctttttgttaattattcactgaaatggtaggtattaatagtacacctttagctgtccagaattagatttatgtggatcagatggctcttgtgggagataaactgataggctttttagattgtcaatgaagaatttctaaatttaggcacatgttttgaaataaaatttaagttagtccatctcagcctaatattgtcattaaagcggacagatcttgcagttttgttgaaagagcatagttttggtttttcataaaaggaatatcttgttcccaccatgaattactgatgatttgaaacttttcaaaggtattggacctcttgcagttattttaccctcatttatttagtgtaaacatgggacagtgtgtttgttttacttcaagattttaaaataaagtgttagcgtgttgaggttacatactgttaccactgtttgtgatgttcagacaattaagtgagggatatgaaggtaataaaaacaaagctaagtacattttaaatttgttttccataaatgtgttcagtcttatattggttgaaggaaatactcctaataaaaggcaagatggtttttttttttttttggtttccaaaccactctttcgtttgaaaaatgactttcagtaagcacgctgtgttcattttaagagtttaccaagttatttaattacacagcgagtgcagaggttaaaaatatgatctcggggtaaaatgcccagatgttcagatctgacactaactagctctgtgttcgtgggcaaattacttaatctctgacctgttccctcatttttgaagggataatgtggtacctacctcatacaaggattaaatgagccagaggatgtatcatatttaaaacatgcctagcaatggtgaatactcaaaaagagttagttcttattattacgttgtcgtcatcattactactattattgttattactttagctactttcgaagatgatacgccttctgttctggggtgtgggcatgaaagatatatttgtttacctggtagcaattttttaatgcagagtttatttgagaggttcagggagagagcagtatgttaactgctggatatatccacaattggccatagtgcaggaaattcatagaatattaagcttatttttttcagtaacaccattccttttgttaggtataaagaactatgcctttttgatgtttgagcaaaactagattatttgagtaattgcaacgtctttattaaaatacagttatcttggtatctaaaggctagagtctgtgcagggggagcctcaatttctaaatgatccattggtaagacttttttttaagcagcaccattttcccacagaaaaatgtcacataatagtgttcagattcccaagccagcccaacatatctgaatttgaatactgatagtattataaaaactaacttttatgtgtaacagtgtctcagcaggaacatgcactgagtacatcaagtactgaaagattatgaacacaatcttgcagatatggcagtagggctatcttcctttgcagtcctagcaaggaccgtcaagccttgggaagagaactctctcctctggtagaggccgagggtaagtagtggagactggtctctagaaggcagtagcttttttctggcttggctccttaaaaggctgtatagtatagtggttaagcgcatggactgtccactcagagtgcttatcttcaaatctctgttctattacttacagaacttcccatctgtaaaatgtaggtaaaagtagtgcctcccttatggggttcttgagaggattaatgtgttaatacgtgtgtagtgcttaaaatagcatctgacccatgagtgagtgcataagaagtgttatgtattttttaattattcagcttgactggtctaggatctctagaatacttttgtctgcttggctgtccactgcccacatcttttgcactaaataggattcttctctttcctttctactgaggaatggtttcagactcttcattcctgcctgaagtattttttaaggggtttaggggggtttattttattttttaatgttggagaaatagcattcttctgtgaacccactccatttccccatttaggccttgtgttgatggagatcatcatttgaagaaagatattgactatgggcatttaattgagtcagaattgaggtgcaaatttctcaacttttagtagtttttgctaagtcatttctttttaaataagctttttattttggaataattttagacttacaatgaagttgcaaagattgtacagaattcctatatactcttcatccaagtatatataaccctggtacctttgtctaaacgaagacattaacattggtacattattgttagtgagactgtagattttactcgattttaccagaatctcactaatgtccttttgctgttccaggataccatgttgcactgagttgttaagtcatttttaattatttgtttttatatcatggagccctccagttctttagtgaatagatttctgtggttgtaaagccattttctgttttagttttaagttttctgcacatactcgaaggctaggtgtttcctctagggatggcaagtccagggatttatcttggcactgaactttataggttgaaataaaaggagagagtcctattactgtggaaagaacactatggtgatggagtgtaggctaaagcatttttataatttaaaactgtgttttcatgggactaaatgagttattttatgcactattcacttttgatggatttgatttcaaaatgacaagtcattcttcctattaaaaaagtgttaagcatacttcttggatatagaagctaattgaaatgaattggagaatttaattttttagtactcatcatagttatgattgatttaataaattaagttagtataatttcagtaatttagaacatttgtttatatgcgcttttagaaaatccttggtttcgatttgtggcaacaatccagtctttttgtttttttcagggataccatatgtaacaggtgccattgttactctaacttttcacacatgccttcagtttgatgtcaaagtcatcatttagtgtaaacagcaagttatctgttaggctgcacatcatgaactttacttttagaaagtcttatcttttatgccacagaaatagcatttggctattagtcatggatggcaaagaaattaattttgagttgtttggataaaaatgtttcagttgactgtagtgtgtattgagagacactgccagtaaacaaactctcttggtaggtggaaatcccctagaagttacagaaaattgggaggaggtgaacttaattaaataacttgaattgtttagacatattcagagcttcttatgaccttgaagaaatcacccaacttcaaaagacctcggtttcttcatttgtaaaattagggagtttgactagatgtgtaaatctagttgttagttaacttctaagatgtaaaaaccctcttgtttaacaaaaacctacaagatcaagttgcttatctgaaatctttatgaatcaacactagtcactaagtctagatataagtcagtttatcaattgggttcaaatagtttcaaaccaatattactgtaagtttgagagtcactagttggtttgacacctcttgtatatttttggtaattagtatattgctttttaaaattttgttatctgatttttgtgctttaccctgaagcaatgaccttcaaacttttttctcatattccctaaacaattttgaaaaatgtactcctttacacttaaaaaaaaaacaaaaaacctcttactgaagtttaatatgcagaaagtacacagaaagtacggtagtgaacaactcagtgaattttcaccaactgagcacacttgtgtactagcacccagatcaagaaattcttactaccttacccccctccacccccatccctgcatattgtcctaacttctaacaccacagattaattttgcctacttttgtactttatctaaatggactcttttgtctctgacttcttttatgcaacatcgtgaatttgagatgtatttatatcgtatgtagttgtagactgttcattctcattactgtatactattccactgtatgaatagatcattatatattattgttgagggatatgtacgtagatctcagtttgtggagaatgtctttgtgaccttggagtaggcaaagatttcttcagcaggacttttcaggagtaattattttacagtttagattggataaggaatgggagaactggtttattgaaatatgagcagttaaatttttttaaatgttaatatgtagttaaaacttgatattctctaaatctcggggagaatgttaatatttttaactaaatcttccaggtaacaggtttgtgctttcatgactattttgggaggaatttcttcaaaaatgtgtcatgtacttctttgtctttttgacttgccgatttgtaggagttttttactatatgctggaaatgagcccttgctggttgtaaatatcttctcccactgtgtggcatgctttttctatttcatggtattctcataagattacctccaaggtattctctcatcttctagaagctttgttgttttggctttcacatatagatctagcatatacctgaaattgatttttgtattttgtgtgaggtaggggataataccgtcttttcctatatggatagctaattttcccagcacaccatttccctgctattgtcaggaatcaagtgtccatatatctgtggttctgtttctgtgctttctgttctgttcctttggtctgtttgtctctacttgtactgatgccacattgtcttgtttattatagttttatcataaaacttgatatctagtagaacaagttcttccacattgtccttcgaaagcatcttcgctattcttggccctttgcacatttctttgattttaatatcatcttgtcattttccacacacacccacaaaacctgttgctactctgattggaactgcatggcatctagagagcaatttgggaagaattgacatctttatcattttctaattcatgaacatgatacactacgccatttatttaggtctttaatttctttcagtaatggttgtgattttctccggaagattgttcacaacttttgagagttttatttgtagatatttgatattttttgatattgtaaatgtttatagccattattttgtttgtttatatctttatattgaccttgtatctaataattttgctcaacttttagtcatatatctttagagtatgtatttgatcttttactatgtattcagtcttcttatctgcaaataaagtcttgtttcttcctttcgaaatgttatacttttgtttcttatcttactgtactggctagtatttcgattataatgcagaatagaagtagtaatagtggcgctattgtcttttttcctttcttgaaaggaaaactttgaacatttctccattaaatatgatgtttactttaatttttttctagctatcatcagattaaggaagtttcattctgtccttagtttattaggagcttacatcatgaatagatactggattttatcaaatgtttttcctattgttaatataaccataggatattcctcaagtcaaattatattgattgatttcctaatgctaaataaactgcattccagaaataaacctagcatggtcaacatcacattttcctctaattttactttggaattttagatctttgttcgtgagtgggattggcctgaaattttgtttttcttgtactgtccttgtcaggctttagtagccttgtaaaatgagctaaggaagatacctgctttttgattctctggaagagtttaggttaagtttggttttattttttctttaaatgcatgatagattttagcagtgaagccatttaggcctagaattttctttgtgggaaagcttttaattacagatgcagttttaaaaatactaatagtattcttcaagtgtttctattttgttaatatctgcttttatattcagtatattttatatacctttttaggaattattttgctctttttctttctaacttcttgagatgggtaggtaggtgtttatacccttgtttccttcctgacatacatatttaaagctatacatttcattttcaagtattgctttacctgcatcccatcatttttgagatgtaatattttcattatttcacaatattttaaaattcccactgtaatttcttttttgatccatgggttttttaaaagtatatttcttaatttccagtaatatgagaattttctaactgtgtattttttgtattttgtttctggctttaacacattttccttagagaactttgagtgatttcaatcttttaaaatgccctgagacttactttatggcttagcatgtggtcagtttttgcaaatatgtaagcacttgaaaagcatatattctgcagttactggacacagcattctatatatgtccattgatcaagtttggtaattgtatcgtatctctgtccctaccaacttttttggtctgcttattcttttaactactgagagagatatctttctttctttcttttttttttttttttttgagatggagtcttgccctgttgcccaggctggagtgtgcagtggtgcgatctcagctcattgcaacccctgcctcccagattcaagcaattctcctgcctcagcctcccatgtaactggggctacaggcacgtgccaccacacctggctaatttttgtaatttttgtatttttagtagagacggggtttcaccatgttgaccagactggtctcgaactcctgacctcaagtgattcacctgcctcggcctcccaaagtgctgggattacaggcatgagccaccacacccagccaagaggtgtcttaatatttgcccctgagatactaatgcatgtctcattctcctagaagttttgtcaacctttgctttatatataatttgagtccatgttatcaactgcatacaaatttagttcgttatattgttctggtgaattaagcattttatgactatgaagggactctttttaactctagtgatcctttttctttgattctattttgtctgaaattaatacagcaataccatctttaatagagcaataccatctttattttagctaatgtttgcatgatatgtgtttatccttttacttttaacctttctgtattcttatgttttagatggggctcttgaaagcaacatatagttgtagattttttttaacccaatctgataatcattcttttttgaaacatttgattcatttatacttaatataattattgacattttggggttaagtacagcattgcatttttattctactagctctgtatttctttttccccttgtctttttcttttatttgactatttttatatcatttttcctttattacttcagacatcacttattcatttttattctttttgtgattaccctagcatttatagcatgtattcttcacttatcaaagtctagtgttaattgatacttctaccttcctcctagttgaagcaagaatattaaagcaccttagttccatttacctaccttgtgacatacatattgttgtcctgtaatttaattttctgtatgtattttaaaccttacaagacattattttatacagtcaatattcctttagatttcacgtgcttatttgaacttcatgggtcttcattcctttctctatctgtgaccttccatcttgaggcagttttcttttgcttcattcttagtgagggtttgctggagatgaactctgtttttatttgtctgagcctgtattttaatttttttcttgaaggatattttctcctcagtggaatactaggttggcagttgttttcttcatgcttcttggagatacacagtcttttagctgccatttttgttgttgaaaattaagctatcaatctaactgttgcttctttgaaagtaatctccccacctctgcccctgctgcccctccatcaggatgctttaaaactttcctttgtctggtaggaattcattgagattgttacacatgtggtttgacaggtttcatcatttttggaacatttattcaaatattgcctctgccccattctgtctcttttccttctgggattctgattaactcttggatattagacctttctcactgtatcttccatgtttcttaccctctcttcattctgagcgttttattttcccccgacctatcttttggttcactgtctcaacggtgtctattggctgttagacctgtttattgaattcttagtttcggtttttgcatttctcagtaataaaattattctttgcttcttttaaaaatctgctgtgtagcccggacaacatggcaaaaccccatctctacaaaaaaaaaatacagaaattagctgggcatgctggtgcatgcctatagtctcagctactcaggagactgaggtgggaagatcacctgagccccagaggtcaaggctgcagtgagccgtgatcacgccaccgcattccagcctgggtgacagagcgagacccggtctcaaaaacacccaaattctgctgtgtcacattttatgatttctaggtcattgctgagatttttaagtttggctttcatctccttgaacatagcaagcataatttaaaatccatgtctgataattccaatacttggagtccttctgagtctcttctggtcatcttattatgtttcctcgtgtgcctgattgtctttaattgcatgctgggcattgtatttgaaaaattatttgaaaaatcatttgaaaccaaggatgatagtttttcagaaaggagtgtatgtgtgtgtgtgtacatctgcttaagggaatccagaaaatccagagttgcttaatcaaatctcagctttagagaccttcctgggccaaccagatgactcaaggccacatcacattcagtgtgtgaactgattcattgcgattcacccttatttctaagttgcagcccttcagggtcccaacccgaaagtgggtgaagaggattttcccttttgtccttctgttttggctctttgacacttttaagaaaggcatttcttatattttgaccaaccctattccttgccttcagatagggaggtgctttgttcgctctttatgggcaggattttcttagaagtggcaaagactgtcattttctctaagacttcagactcagccctagttctgtttaagctttgttttatatagctgtactcacttgtataattatatacatttttaattgaaaggttacattgtatgtgcgtaaatataagtaaattgtttcctgaacactcagcaatattttaagtctcttcaaccttggtcaattgctagaccttgacaatggacaggtttatttaaatttcagctacgtctggaatgactcaaaagatgaaatccctcttaattgctattgaaattaggatgcataatatcaactaaaattttttcctctcatggaagagaatactttcctagttacacttttgcaatcacatcttctgtcttagcatacttatatgtaggtataatatatatctgcccttgtgaaataggaaaaaaaaaaaaggcagttctgctgagattcctagatttctgccatatgagaaccctcaaacaacctaatcaatgaacattgtgctttacaaacttttttccttctatgtaaattaataacccacagcagccttgtgaggtaagtatatgataggtgtgatattaagcaaaggattaggaaactgggcctaagaggttaagtaactcgtctgtcgtcccacacctggtgaatggcatatgttctttgtctgttaatattacagcattgtgtttcagctataatggccaggtaactcttgcctgcatatgctcactgacttcccagttttatcatattatgctttcttctttctgtaagtcatataatatcctgaccccatgactcatgtcctgaagattgagacaattgggagattactccttcatatctcatcctcaccgcctcccaccccatttctagaacatggtaccaccagctctggaatttgccaacctctctgccctgttagaaagcttgctgtgtcactagtcctttctcatccctacacatacagtccctttctctctttttagacatgtctcaatttttccagttctaaaagagatgcgtctttgctttccagttcatttaccgtctttcttggcactcagggcttcctttgttgcttctccagtcactcttgatgaaatcctagccagtcttgtttgccttatccttctgaatcttaagaagggcaaaaagcttatctgccttgtacttcttttccagcaatagagtcaatgctcctatacttctagtgattctgcttctgaaccgccctcatatctcattttcaaatcattgttttcagcatccagcaacatccttgctactcacttgtaatgatagccttgaacaattattttacgttaggcctgtgaatgtcaaatacccttgtttatttgtaggtacttgacatttgaacgttttatttgaacatttctaaatgtacacaaatgaaaggtccaatgaacctctgatgctacagttacatacgttttaccatactagtttcatctccttactcctcttttttccaagaattaaggcatagccaagacataatttcactccccaataatttaacatctctaaaacaacacattttcttacatagctacaatgttattatcttatacagcacatacaatacagttcttaatagcacatataatacagttgacccatgaacaaagccgaagttaggagtgctgactgcctgcagagtcaaaaatccacctgaacttttgttgttgttgttgttattgttgttttgagacagggtctcactctgtcccccaggctagagtgcagtggcatgatcatggttcactgcagcctcaatcccctgggctcaagtgatccttccacctcagcttcctgagtagctgggaccatgagcatgcaccaccacacctacttttttatattgttttgtggagatagggtctcctcatgttgcccaggccagtcttgaactcctgggatcaagggatcctcccgccttgccttcccaaagtactaggattacaggcgtgagctactgtgcccagccaatgtgccacttttgactcccccagaacttaactagtaatagcctactgttgaacagaagccttatcagtaatataaacaattaacacatattttgtatgttacatatattactgtattcttacaataaagtaagctagagaaaagaaaatgttaaaatcatagaaaaatatatttactactcattaagtggaagtagatcatcataaaggtcttcatcgttgtcatcttcatgttgaagaggctgaggaggtggaggaagaggtggggttggtcttgctgtctcaggcatggcagaggcagaaaaaggggaggaggtggaaggagaggcaggcacacttgatgtaactttttttttttttttttttgagacggagtctcgttctgtcgcccaggcgggagtgctgtggcgcgatctccgctcactgcaagctccgcctcccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggccgtaactttttattttattgaaaaaaatccacatataagtagacccacataattcaaacctgtgctgttcaagggtcacctgtacttagtccatccttaaatttccctaattgtctaaaaaaaattcgttttttgatagttggtttgtttgcaacaggatctactcattgtatttggttataccccttaagtctcttaattctcttataatgtataacaatcctctctgctttttttcatcctcagactatgccattctggtgagatattgtttaacttgtttctttatcctcttacttcatatggaccggaaattagatctatatgcttaattaggttcataatatattttcttggaggggtgggcaagagtgcttgtggtcacttcatattacatcacatctggaggcacatatcatctggtcatttcaccttaagtgttgtgaagattcatcagagggttcaagtggtgacagcttgatccctttgtgaagcccaaccttttacttaatgctgttagcatccattgattactggtgcatgaattagttatgtaattaaaggttgcaaaattgtgattgttcaatttggtcacttctgctattattagctgaaatatttatatatggacaaactgctttctcattcacaagagctatttggttaacctgaaatatgtagtcatttattgaattgttaaatgtataactctattattttactaaggcttatgataaagtgattcttgaagaagttaaagctattcctgaatgttagattagtaatttttgtgggttgggtcatggggaaggtcttccaatcctgagcgaacagttctaatcctattgagaaaaggtagggtggcagggaaaaacaaacaaaaaaacagaagaaaagattgtatactctcttcattattgtgggcttgcagtgcgggtgtggtgcttacttggggtatgggaattttaaaaagttcctctactttaccagagactacatcagactcaccacggagtcctttaaattttaaagacctatggccctaaaagggcctcagcacagttttgcaatcaagttcattaaattttaatgactagtacatcttgggaagctgcagggactcctgatggttttccagggatgcagctaaagctcctcttgctagctttctccgaagctaaaatctcaggaaagcttcatttgtcccctctgctgttgtaaagctctaccttaggcactcgaggtgatgagagaggagcaggctggctcaggcagtcaggaaaactttctcttagtatcaattaaacataagtttcattcactgaaatttcatgtagtaaaatggctgcctgctttttcatgaccttttattcatacactatatcacttgctcatactgttgtatttaaagctttcacagtttgaatcttacctcattagccttttatttttcaggacactgtcttcagccttttcttcaagtttttgaccgtggattgtgttgtgtcaaactggatgaattatcttagttgaattttcaccagttgaaaaattggaggtaaggagtatatttcttttttgaaaatgaatctatattactgttaacatgtttacaccctcccctccatttatattctgtgtcctttgtgcacttaagagcaaggatgacaaaataaaagatgtccaagtgatttcatgtgtttagatttaggccctaagagcagcagctgctactgctactactagtactagtactactactactgctagtgggagttacaagttctttggacaattcatttgctattagaaacctcaccagaaaatagaagggtaatttagcagtttattttgaataaaaggggctaatcctactcaggtgccagatccccagcactggagctggtggagattgaaagatctgcccccaagaaataactagatgtgtgtgggatatacgaatcttccaacttcctagtttttgtaatttttcttattctcaaatccatgttaaataactgaattaagcagatggtaaatacagtattatgaacaaataagggtataattttgttagtggtattgtaaccataattcttgctttgaaccattggtagatctgtatcaggaaagactacataacaatatcagccgtgatttctacatagtttatctttctaccttatgaaaatgttcccactttttataacatctgtttcctagtatccagcatgggtatgtgctgtgaattaaatacttaggcaagatgttgtgacacccgtttaataatcttggcttttaacaagttttaaaatccctccagccttcagttatcttcttgtgtgaaatgtttgtatttgggttgagttcagggtttcgcagatttggcactattggcatcttgggctggataattttctgttgtcaggggctgtcctgtgcagtgtaggatgtttagcagcatctctggactctgcctgtcagatgtcagtggcacctttcctcagtatgacaaccaaaaatatcttcagacgttgccaaatgtcccttgcagggaaaagtcacccctggttgggaactactgggttagatgatgtggagtttcttccagctttataattctattgtttttattttaaacaaaaaacctattttttgtaatccagcttaaatgtcatctcttccctgaagctttcctcagctctccttctctttgttctaccttcattgtttctttttctgactacttattatagaactcaaccccactctattataactgccagtgtttctctcactacgaggacatgggtcttctgtatcgccaagcttagattttattaaatgagtgggcaatgggttagaaattgtttagttaatgattataaatagcatttctgttaatctttcaaactcttccactaggaaattcccatagttgtgatcttggatttcagggttaatgagactgattattcattttttaaaaaaatcttttaaatatattagaaggcaggagcctcctataggtacgtgaggatgctacatgaacacatctaggctgcacttgagagaaatcacacagaaattcataacgtgaagagttaagtcatttcaactgtcatatccagagggtttctccagtacttccattttgcttcttaatcagcaagcttccatctatttagaagaaggtaacaaggaaagtagtaatatttttccttgtataacttaaaatatatcaccatatttgaagtcactatttctcaaacccacagtaagaaatacattttaatcgtgatctagtacatacgcacatacctgaaacaagttttttgaatgagtatttgccattactgtgtgtgaaacacttcgatattttctgttatttctttttcttttccccttatagtcatcacgtagtacatttgttatacaatacattaataaatcaaaacccaccatttgaaaaacactgttctaagtaatctctttaagtaataaaatgtgcagatgatctgcttctggcatatgtcaccaataggttgttctatctttcttttaaaataacgtcatttaggaattgatgcaaccaagaccttaaaacaccttgaccagagcaaattagatttccagttattttcaaggcctatgttttgtcatttatatggaatatttagtgtgtacaaggcactgtagccaaaagagcatgtttgattcttgttctcaagatttatagtgaaaaatcctagaggagaataaaaagttaatatactaagtgctgaaagtgataatcaacacacagtgacttttataggcatttatgaaagggagaaaactttgtaggcatttaggagggggttaacataaatgtgggatggcaaaaaacaaacaaaaggctgggcgcagtggctcacacctgtaatcccagcactttgggaggccaaggtgggcagatctcctgaggtcaggagtttaagaccagcctggccaaaatggtgaaaccccatctctacaaaaatacaaaaattagccaggcatgatggagggtgcctgtaatcccagccactcaggaggctgaggcaggagaatcgcttgaacccaggaggcggaggttgcagtaagctgagatcgtgccattgcactccagcctgggtgacagagcaaaactccatctcaaaaaaaaaaaaaatgtggggtggatttcgcattgttgtatcagaaagtagaaaaaagtattacacatggtagaaacagcatttatgtcagtgcacagtgcttcttgctcatacttgaagttagtttttttttttttggataatcaaagtaactgagaaattaaaaaataagaaagtttggtaaactgcaaaattaaatgtatgatataaacacagggtatgttattttagctctactgtggttgtaaaatgaagttgactcaggagatcaattagaaacttgtatgtatgatagctctgataaaagccaatatatgccctaaaatgataatattaacattgaattactaggtttactgagaatgcggataatctctaaatggggagagagagtgctcatctgtcaaaataagtgaataaggttacaattctctctctctctgtctctcccccccacgcgctctctctctctctctctctctctctctctctatatatatatatatatataagctatatatatatatatatatatatataagctatatatatatatatataagctatatatatatatataagctatatatatatataagctatatatataagctatatatatatataagctatatatataagctatatatatatataagctatatatatataagctatatatatatatataagctatatatatataagctatatatatatatataagctatatatataaaagcttatatatatatatatataagctatatatatatatagcttttcactaaacagaactaaacagaaaacagggtttataatagaggtagcatttttcaaaaagttatacacactttgtgctatgcaattaaaaatcatataggccaggtgtggtggctcacacctgtaatcccaacactttgggaggcccaggtgggtggatcacttgagcccaggagtttgagaccagcttgggcaatatggtgaaaccccgtctctatgaaaaataaaaaaattagccaggtatggtggtgcacacctatagtcccagctacttgggcagctgagatgggaggatcacttgagcctgggaggttgaggctgcagtgagccgtgagtttgccactatactctagcctgtctcaaaaaaaaaaaaaaaaattatatgcatgcttcataggcctgggcttaatcctctcttttctaaatagaatggaggctcaggatgctaagtcagaaccaggtgttgacttaagaaaataagcagtggacttgtttttctttttgaacttctgctctcttctgtgggataatgtagaatttagttgctgtagaagatatttctgacctaaaagaaaagaagattcagtttgtaaggatacttgggaaagagccaacctgccctgaaagtgtggtctagcatcctgtctgctgttactttgaggcaccagaagtctactagttttttgttattttccatattgagttgggaagttagcaaaaagataaccatcttttcgttttctcagatttctagactactgaaaagaagttgctttcagagctggagatgtgaataaaatttctgtgccagggttgataaaccatcttgaggtatttttttttctaattttaaataactctattttttaaaacagttttagttttacagaaaaattgagaagatggtacagggagtccccatataccctgcactcagtttcccctattattaacagcttacattagcatggtacgtttgttacaattagtgaaccaatattgaaacatgattattaactgaagtctatattcagatttccttaacttttactgaacatgttttttttcctctttcaggattccatccaggaaaccccatcacagttggttgttatgtctccttagactcctcttggctgtgacagtttctcagacttttgttcttgaggagtactgatcaggtattttgtagactatcactcaattgggatgtgtcagatggttttctcatgggtagaatggggttatgggttttaaggaggaagaccacaaaggtaaagtgccattctcacattctcatcacatcatacaaacagtccatactatcaacgtgacttatcactgttgatgttgaccttgatcacctggctgagaacgtgtttgtcaggtttcttcactgtaatctttttttttttttttttttttaaacacccctttcctgtattgtgctctttggaaagcagtcaccatgtgcattccacacttaagaggtgggaggttatgctccacctccttgaggtgaattatctatgtaaattgtttgggattttctgcatgggaggctccccccacccctcatttatcattcattcatttattcagtcatttctttatctcagtatgggctcatggctatttattttatacgttggatcataatataatactactttatttattttggtgttcaaatttttccagctttgaccattgggagctccttcagttggctcctgtgtcatttcgacatgccctcatcatcatgggattttgattttttagtacttccttactttctggtactacaagatgctccaggctcatcctatatattccctgccccagttttagaatcatccatttctccacagggccttggttccctttattaaagagagaatgcaattagaaatcaagaactgggtgctgggtgtgctcattgctactggggtattgttgcctctatgtcctctcagctgaaatttccgtgtatatagtctatatatttatgcatatttataaatatttttatgtataattttaatgtggcagctaacatattctttgtggggggtgttaagtttaaattaaatatgaatctatcgtttctggaggccatatttaaattgaaaatgtttttgtggattattttaatattatttcagtctcatagtatatctcttgagacttacagaatatgagatagatgcagtgaatatgtgactatttcaaaatggtctctactgtaataaaaatcctataggatgactgtttcataaattatttagaaggcttatttaggggaaataataactatcgtattcctctcccccttgttatttggtagcacctttacatatatgcatgaaaaatcctgaaaatggaactcttatctctgccagtaaaagaccatttgttatgcctcaatatcagccactttttgttactgtttaacttgaagaattcacactgtagtacaaaaactcttctgttttaaaagcaaggtttgctttaaactgttgttaagagttatgacatcatcagagtcttaccaggtagccagtagtacagaagaataatggttaagagcataaccttaaatttgtatcctagctttgctactggttgactgtgtaaccacaggcaatttatttgccctctctgaacttcaagtttccttatttgtaaaacgtggatgataatattacctctctcatggaagtattttagggattaaatgaggtaaagcacttagcacagtacttgatactcagatacggctcagtaaatatgatctaaaatcaaaacctccaaagcagcaaaaaaatagatgaaagtttgaaagctttatactcatatacatactgtgttttgttcaacaattattactggaccagaccaaccagaaaaattaatgattcttttattttgcaatcctaaaagttctctcaagacaaggctaacttttcttcaaacctgggaaatgctcactcacctcattaccttaatatgctagcagtggctgtcagcccaagaaagtattgcctctctagaggccacttgggggtgctactgagattttatgggcggggccagaatgctaaatacctttcattgcctgggatagtcttgcatgacgaggaattcttgtgctccaaaattattgcatcaatagtatgccgttgagacacactagagtacactgatacttaccattgtatctttaaacctttctgcagaacacatttcaggtgtcacaaacccagcaggtatctagatgagtgaagcaaggccaggctgcagtgtttggaatcagctacggagtataggaactaggcaaactgtccttcctaaaaggggagtggtgccttagtttcagccagttgttgcctgcagttgctagatcacgtgatttttcagagaaaagctagatatgtacatttttatgtgatgtctcccagttttaaatgtagctcaactttaaaaaaaaaacacacacacacacacactgtgatggccaaaccaggcagatctgtgggctgaattcattccacagaccattggtttgcaacctctgatataactgtttcaggaagtgacctaaaattctgacagaggtaaaacactctgggccataatggcaccaccctgtttatttgctgagctcaggaaaaactgtggaaacaaagcactagatgtcgacatcattttctagagtgtggggaattgtggcattagagcagagctctgggggagcttcctctctgattgggaggagcaattctgttgggagacatcctagcaattgatttttcaggaacagaaaccactgtgccttgtgttaccagcagtcttgaattagggaggtggctgcaccactgaaggaagcctctgattccactgctaagcatagcatctgggccccatagtctgtcttgcctttaagaaaagaatcctcacaaagctgacatgcaataaaggcttaaaactctgcagaatctcttggttcatgtggcccctgaactgtgtgatgatcatagggtttatgtctttagtgtttcttctttcttgatctagggttaccgcctacacagctccacaatccacagctgtggccatctggactttagtgggggtgtttcaagggtgtcccaggagtttggtcatgcctgagcctagcctgtacagcttagatactgcttgagtcctctgtctggctttaaagtgacaaatcatcattcagcacttattgtataaaaaatagcccattataatgttaagaaacaaactcaatgtgtattttgcttagtagttgttgcctacattgatatatttggacaagaatagattatatgctttgatctgcatggtagccacatctataatatgacactatatgacagtgttttcattttgtttctattggattaaatacaaaagtacagcataatactttactgtaaaactttgtgtttttaaaggaaactgactatattaggccattcttatgtcactgtaaagaaacacctgaggcagggtaatttataaagaaaagaggtttaattggctcaggattctacaggctgcataagcatggcaccaatatctgcccagcttctggtgagagcctcaggaagcttacaatcatggcagatggtgaagcaagagcaggcatgtaatatggcaaaagcgggagcaaggcgggtgagggagaggtcctagagttttaaacaatcagatcttgagtgaatggaacaaggactcacctaggatggtgcttaaccatttacaagggctctgcccctatcatccagtcacctcccatcaggccccaactccaacattgggaatcacatttcaacatgagatttggaggggacaaacatccaaactgtatcattgacttaatttattggctggaatattttctgtttgtaaacagaaagcctcccagtgaacaaaatggaagttgcttttttaaagtattttaacatgatatagttatcaaaaaattaagtttgagagtgttatatattactgtgaaatactaaatgattattcatgtcagttagcgctgatgtgagtgaatgtttgtacagggcagagtgctaaccactattaagattacatacataatcccttaagaaggatatgtgtttaccagtttagattcctatttgttgtgaaaagtcagtctactattaatcatcttttcagatggtagccatttttgtaagctgttggcttccatttgaaagatgctttaacatgtttcttcaaaggaaagtatttataaccattttttaaaaaggcattttcttcttgtgtgtttaaacagctaacttatttgtacaagaattattttttccttccctctcagtcttccacctcaccacacacctttagctccctatgtgaatgataaacttaatgagggtttgctccttagccagtcaaagaaaggcactcatcattagaaatgtctctgatacctactagtgacacagtggaaagaacacagactttggagcaggcaggcgtggatttgagtcatgattctgccatatgttcattctttgagttcattttcttatttgtaaaatggagataatcataactacctttgagggcatattattagctaccagtaaatggtagctaattatagtgataaaaataatggtaaccttggattcagtagcatctgaggtttctgaaggctctgacaaagctaggtgagagctggccgctctcaagatctctgaagtatatggagcctatgcttttgacacctgaagcctgtctgtccgtgttttgattcttcttgccttttcttctagctcataaaaaagacaatggtattgcccttgtattttaaaggcttgtaattaaggttggaaaatgaataaaaccgtttttgggagccattgggaaagctggagttaggcctttggctgcttcagaagctctttattgaaggtttgattaaatagccatgaagtgttctgaatgtggtttagcacctaaaatactgggatcacttcctgttaggaaaactgttatttctgtaaatacaagccgatttgattagttaaggtcatccctaccattaaattcagtgaattccttttttctccccatttctcctaataaatatttattgaacagctagcctgtgctaggccatgtgcctactcgattgtataccctcaaaggagatgttgaattaaggaatctaagagttgtaggtagtcgcctattatttaaatgaagatcctaaagccttagagctgcactgtccagtaaagtagccactaactacaggtggctactgagcactggaaatgggaccagtgtgaattaagatgtgctgtaagtataaaatatacactggatttcaaagatatcatttgaaaaatatatataaaataactgattttatgtagattacatttaaaacaatacttttgacatgggttaaatgttacaattaatttcacctatttctttttaagttggccactagaacatttaaaattatacatatgactcacatattttttactggacaatgctgccttagagcttcagtgacttggtaggattatacatctagctaggactcctttggccagtggaaattataaattgctttactgtgaaaatggaagatagataattcaaaccccattcagaaaaaagttaaattaacactaaggactttgaaataatttacattttaaattaaatcctggattgttaatctggtagcatctcttagtatttcagatttggagttttcaaaagggacaaactggaaaaatatacccattgatttagaagcgtaaaccaatttttttccctatgtgttcacaaattgccctatataggtgactccactcccctgacatttgctgggtggggggatggcaggagatggggggacaagagtcatctaaaaggcttgtctatatatttttctttgaatatgaatagtgttttatccaaatctatcttattaggtagactggtttagtatagtgaaattgattcatcatttaacagatacttgagtagttgggctctgtaaatacagtggtgaacaaggcacagatcttgagtagagctacaggcttttgtttggttagctggtttttgttgtcatttttactttttatttggaaataattttaaactgactaaaaataggagaaagaacaccgcataccctttacctaaatttacctattaacattttcctatttgctttatagttgtctgtgcacacatgcatgtgtgcatgtacacatgtttgtatgtacacatgtacatatatttttttctgaactgtttgagagtaagttgcatgccctttaccactgaatgcttcattgtctaataccgaaaaataggaatattctcttatgtaaccacagcacagttatcaattcagaaaacaggaaattcaatacatttaacattgatagaatacttctaatctaccatcaacatttcactttggtcagtggatccactcatttattttattaacagttttcccttttagtataggatcaggatcaggtaaaagatttagttgtcatggctctctcttttttaacctgggacatttttcaaacctttgtcttaaaatgacatttcctttccccttcgctttttaatagaaaagcccaaaatgagaaatgttctatttcctcatgattagtttcaggttatgcatttctgactgtaatactataaaatgatgtgtttttctcatggtgtcacatctggaggcctgtgcagtccatctggccctcattggtgatgttcatcattttgatcacccagtcaagatgttgttcaatttgtccactgtataattaaatttttcccctttgcaactaataagctttgggtacacacttttaaaactgtgtgtatttcctactcttcatccagattttcccctagatttagcatccattgatgatacttgcttgaagtagtctatactatgatggctgcaaaatgatttttcttccagctccagcactcctgcatgtttaccaattggattttactgtaagcagggacttcccttctcccctatttttgtaggtatgtatttagctatcttcattgatacggacacacggctccctcttttctacaggtttataactcattactgtcttttattattttggtattcaaattgttgcaaatgtggccagtgagtgcacctcttcaagttgacttccaggtccttatatgttcccatcacttcttgagtacttcctcactgtctttaataatgagctatattccaggtggggcttcaggtttttgttttttgttttttttttttaaataggtgagacctttaggtgcatagatggtttcagtatagcgtgtttagtgtttctgtgagggtaagcacagcctgctttggcagcattgtggaggggagaggcaaggcagcaggactaagaaggagtgtcagtggaagcctccttagaggagatgccaccactactgagatgtataggatcaataggaataaagtaaaatatgtaactagacttaaccatactttttttttttttttaaatagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacaggtaagttacctaccagtgatagtgatattaagttctagtttttcctattagagctggtgatgtgtgatgtaattagaacccaggtatgttttcttgtgtgtgtgtgtgtgtgtgtgtgtgtgtgtggagcaggatttccctcaaccttggcactgttgacagtctagcctggataattctctgttgtgggagtcggccttgtgcattgtagaattactaaacgttctaggcatccgaggcctctacccagtaaataacaatagcatccccgcagttgtgacaactgaaaatgtctttagacattgccagatgtctcatgggaggcaaaatctcccaccattgagaaccacagattggagaagaaaataaaagcatgtagcaacaagaaaaacagattctccttatgtttcactttttgaagtttttgggttgtactatcagtccctaagtccttagagttgaattttgaatcttaaatgtatcattttaacttcttagactacacacttttgagtctttttttaaaagtctttagataatccactccctgtttttctaatgctaaatccttaccgatatctaattttaaatgtaagcccattttcactcaccttacctttgttttgctgtgtgtcttacattgaattaaatctcatctcgaagacagaatgtgtctttcccactcaggggacaacaaacagagaagttggcctaccactttccctgtaccccatctccctgtcccactgtccccttgttatgttttatataatccttcacaggatcttagtgttttgggttatggcacttacctatttgcttaactttgggcagcagtacttctaccatgctcactggtcttcctcacacacagtcagtactcatgttcaaactctaccttatggcagtgtgagcagctcaggacataacctaaacctatatacaggtgtggttaattaaaaatagagactcagagaacaatgatggtaacagaggtgcttcctttgtttgcaagccctttactagtctagagctttgggcttatggtttttgtgttacagcttgcctttgctttttctcacacacattcctagcctgaatctcagctctttactttggccccattttggtttctggtagagcaaagacacttcccaccggagtgaaaccaaataaggatgaagcttttagtttaaaccacttcctagcaatcaccttcctcacctatcttagggcccaacctagccctgaccttgttttatttcacttagccctttattacctgcatttttcattaccatttaactaaactgaagaaatagaacttcaaattcagctcagtgaacatttgttgataattacactgtcctaagtctttcacttttttcttcctttgggattaataaaatatattggtatggagatttaccacctactggctctggaaaactgctttattcacattaaaatgtacgaagctcagcagtttgcatttaatgtgcaagccttagagcctcactctggggtgtatcatcctcaatttaggatcactttttaggaatatgatgcttttttgcctcattcctttcaaaagtgttcattatatgtcttaaaaattcttacctctgaaatgattttgatttcttcctcatgtttactgtttgatacattttttatccttatttttctttaaagacatttaacagtcaaatgtgacattagaatctattctggtagttttctttgtacagtacttctgtaaaaataatactttaatatcttggttttgtggttttttaaatttttcttcataggaaaatttactcaacttgtcactatagatatgctgacaattccaactttatatcattttgaatttgggtcctttttgtgacaatactaagtaggctaactcagtgtagagaacatggaatttcagggttattaataaaaatatcagatgttaaagtatccatgactaccttatgtttcaaacgaaactctctagtttttgttttcccctaatccataggtctataaaaaaaaaaagaatactttatttcaccttccatatttttttccttcagatgtctgtcagtgacacattctagttggcaatcagtttgaatcctttggctccaaatttgtttttaatatcttcccttccttgctcaatacgattttcaagcaaggtaaaaataattcaaatctttgagttgtaatggttttcttcaattaatacatctttccgtcactcaaagtattttttgaagtatttgaattttaaattttctatattgattataattgccatttgtcactatcatctgggtagaatgttaatgttttacacgcatgatctcattttttaaagtatttgaattttagtatcaaaaactttatataaagaaaaggttaaaatgatctatagagttttaatacagccaattcattaaatttctaagaattcattttgtaaagatttgctggacttttttttaaacttcctaaagctccagtttaataatgtccttttggccagacatcctttcccttgaaattatcatgtggaaagagcactgggactcaggagaataagaatctagaattggcttttctgttaactagttaagtgcctattgtcaagccatgtaacttcccaggcatctttttcctcatctgtaaatgtgcgttgaattggagcagatgaactctaataggagttctcccaactctaaaattacaacattatgggtcctgttttaggtttaacttcatttggttctcagcagaaatgaattatttcctttcatttttatataaaatgtacttttcctaaaataaatatatagtaatatctatgcatgtacatatctgtgtgtatatttatgaactacagagaaggtcacaataattgggaaacttttatggattacttcaaaagtagtggataatatgtgctttacactagtaaaatagtttggaattctgtatttccttagagaactgctttatgataaattaacattttacaaagagggaaccttttattagtctgattactgtcagttggaacttcaaaagtgtcagtttgctattacctcctttgtgagtgtagaattaaacaattcaaatctttcagtgattttgaaagtataccaagacacctttcagcgggtaaaaacttttgagactgtgagagtatgaatgaatttaattaaggcagtcgacaccaggtttttaattaaattaccctaactcgggcaaagtcatggagccgtagttcaagttatggactttttttatactgattcgttttgcttaaatcttacgtaatggttcagacagttgaagttattcaaggataaatttaggtaaaagaaaaatgagggctgctttagaatttttattgttttaactcttgaggaattttattgtaattctttttctccttttgtggttttagtgccttttaaaaactaaagcatggttatttttatgttttttatcaatttaaatattaataatggatattacttatacttatattgcagcaattgtggtgaatccgagataagcccaacattttaatttgttgagatgcaacaagtataaaatgagtcctggatttggagtcagaaaacttggggttgagtcacagtgttcattagtaggtactttacatttctgtagcagtagcagtagtggtagtactagtaatgtgagctaaatgtttgtaaaataatatgaatcgtttgggtctccttttcaggatagatgaccatgaagttttttgtggttaaaatactgctctctatttattctgtgacagtagtatttgcataactctctggcaaagcctgacttccactattagaatttgttaatgttgccaatgttacttttaccatttttctcccctagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaaggtaaattttaacccttttatgaaatttaatttctgtggtgaggcagcagtctcccattcaaatatattagctgtttagttttaattaaatgtttagtattaaatgttgggcagtagcattgctattaagaataaagttagtggccgggtgcggtggctcacgcctgtaatcccagcactttgggaggctgaggcaggtggatcacctgaggtcaggagtttgagaccagcctggccaacatggagaaaccccacctctgctaaaaatacaaaacttagctgggtgtggtggcgcatgcctgcaatcccagctactcgggaggctaaggcaggagaatagcttgaatccaggaggcagaggttgcagtgagctgagatcacgccactgcactccagcctgggcaacagagggagactgtgtccaaaacaaacaaacaaaaagaataaagttagtgcttcagagtcatgtatagactttgttttaaaacatgaaaatgtaggcctaataaggcttagtttagaaagaatattcatagagcgaaaaatacaagtgacatggaaattgtcaaaagtacaaactacagagtaggaaaaaagagattcatggagaatggactaaagttcatcaaacgaaagaatttgaatcttttctaaagaggatggcccagagggcataatgatatttacatataaataatatataagaagtggaattattggattagctaaaaagtaataatatataaaagtggaattactggattagctaatagtagattattggattagctaatagtagacctaaattagatacagagtttttaaaaagtctattcagattgtttcaagataaccggagaatttagttttctttcagtatataagaagggaagtaattattcagtatgcctggtagtcagcctgttcaaaacacacataagtataaagagaatcttaggacaatagaacaagagggatgttcaggtgatgtcactttggttgcattcagagggctaaattgaagcagatgtggaggcagcatagcattagaaagacatgagagtaaatgccaacccccaagttgaatgagtcttttatacattagcagtgcatatcgaaattttccagtcgcttgttcaatgttgttctctgcaatgacattatctataatgctgtagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacggtaagtgatctgttaggatgtgttaataggagggtcgggatattggctgtcaggtcatttatttttctttaggctttattcctggcagagttccggttttttgttgttgttgttattgttgctttttttaaaaacaacagatgaaggacttttgcctttagtagttctcatcaaaataattcatgtatgcagattccataggctcatcagtattttcaaacactgacgattataatcaaggtatagcatctcatttatttgtaaattgctgtcaaaatagaaatgaaaagtgcaccctgaccaaaaatttgatgaatttattctttgtgtattcatttattcttctaagcatatgatatatatattttttaaacatttaaaattaattatttttgtaagtacattaattcagatgagttagatcaatatgaattttggagaagtgttaactgtagaatattttaaggcagagcagttttgttaagtataaataattgtagaaactgagataacagtattgattgatagcagtcttaaagggaactgctctaatgaaaagattcagataatatagttttaacatgttggttaatatatatgagttctaacgatcccaaacaactgagaattttgaagcatgtttaaaatcttgtgacttcacaagcgatgatccaacctatcatttcacctttcaacatttagcagttttgtgcgtatagtttatgcaatgtggtactatgctagatgcttagtacatacctaccagtgggaaaaatagatacatcaacagataattataatacagtgtggtaagtgctgtatatgttcacgggtaatgagagaatttatacatcaactcgtttctgtgcagattcattgcacttctctgctcttacattaatcctcctgctggaatgcccttctaaaaagctctgcacgtgtaaatcttgtctgttctgttcttcaaggctcaacttaacctctactttttccatgaagcctttcctcattttcctaccctctctaagctaagggcaatctctgagtttacaggtttagagaagtgggcatatgtcaggcctcttgcagtcagcatgtctgcagccactccctcatagagaagtttctacttgaggttcttggcttcaaaggggatctgtgaattctctgaaattatatgcagagtttcataagtgtgtttaatatgggaagtgggtctatagctttcatcagattttcataagattattacattggaggaaaaaaggagtgaggaaccattgccttaaacaataggcagagagaaaaggggaaggcattttagaagagaaaagaacaataaggtaatgaaggcttgaagtcaagatggagagtgacttttaggagacagtaactacagttccctggcataagcatgagatttctgaagagttaacagaggttaactggggctttgaccttgaatgctaggtcaaggtgcttgaactttattctcctggtaacagggaacaagtgggagtttttgagagagagagtcttgagaaattggcatattcactaatttagtgacttttttgtaatatcgtgtatagtcaatattagaagtgaggaggaagattttaactacttaaagcactggaaaataacaaagttatctttaatggaaaggtgatgttaatataaatcaaatttctgcctcattttctccatttgaaatcttaattgaatcctctgattgcggaagatattgaaggacataacccatatgggaatccacccgtagtagttgggtactttggaaacctttaggtacctgtagagcataaacaaattttcttagcatagtaattttctttaatcatatacattttatttagcaactacttgctgtgtgataatccctgctaaataaaatattggtttttttttgtttttcattggaagtggagaactgtctaatgtagcataggttagtactaaaaaaaaaaaaaagaaaaaagccccagattttatatcagagctcttattgatgtatcttttttctttctttctttttttttttttgagatggagagtctcaccctgtcacccaggctggagtgcaatggcgtgatctcggctcacggcaacctccgcctcccaggttcaagcgagtctcctgcctcagcctcccgagtagctgcgattacaggagtgtgccaccacgcctggctaattttttgtatctttagtagagacggggtttcaccatgttggccaggctagtctcgaactcctgaccttgtgatctgcccgcctcggcctcccaaagtgctgggattccaggcatgagccaccgcacctggcccccgatctatcttcttgagaaaggaaaaagagaagttggtgaaactgctgccctgggctgtaatttagttttaacttttattataatttcaaagatacataaaatagtataatgaacccccatgtagccatcccccagattgagaaattggtagttcatgtgggtgctaacatctgagagataagacatttaagtgtttcccatgtgtttccattgccaagcctagtgtaaaatggaggacaattgtagtacacagcagagggacagtacgtggtggttgagaccgtgagtaggctctcaagtcaggtgccagtttgaatcctacttctatttgtcactcatgtatccttggataagtaactttctctatgcttgttttcttatctataaaatgtgtggtatagtactcatcttacgggatttttcttaggattatatgaggtaatatatgtgaagcagtttacacaatgcccaacaaatagtaagtgttcttataaaatatgtgttggttgcaaaatactagacaactttgcttgaggtttagacacataaatctgaagcattttatactttgacttcctttgaacttgaacatatataagattatacttatgtaggaaattaatcaagaaataaatcatttagtcagatttcccattttgctcatcaaggctcatttgaggaaccatgatatagtggaaagagagcccacataggcttgggagtcagaattgctcaggcgctcactggctatatctgatttctctgcatctgattttccctagctgtaaaagagaattatagcaagtacattataataattgtcaagataaagagacagtgtatgtaataagcctggcatgaagtatgtgaacagtagatggctagccttatcattgtcccacttgtgtataggaatacccagtggagaattgacatttttgctactaaagcacacattgctaccttcaagttttcaaacaaactgcttatcaggcagtatatacaaaattgattagaaagttgcttgcctaatgatactgcagtgcacatttgtgaccagctatgtgggggagggaggttgtagaaacttagaataacagtgaaataatctttttctaaggagagcagaagtgcaagatataagatgcatgatggtgtcatttcccttaatctgttatttgcaaagcattatattaaatgctgacaaagatgtcatctcttagatctgtatgtgaaatgagataggtatatctgtgagtctatatgtatttgtgtgagagagaaaatataaggcagtaaatcagaagtgttgaccagctaaatggtaacaatataagtactttcagagttttgagatagaaatgttagctttttacctatagagtttatagatggaacagtttcaaggaggagggggaaatttaagttttaccttgaaggataagattttaatatgcagaaagctgccaattaccccctccctcaagttattcccccccattcttcctgttctaattacatttttggactatcccacagctttgagtcccagaggcataactgagtcccagccaccaaagaacatcagtggtctttgacgctggtctatgccagctttggaaaaaaagcttaccattttttattttgaaatgttggctacaaacatcctgttttcttacagacaactttgaattatacatacccaattttgaaattcctcctgcacgaaaactacttttgacaaatggcagtaatttctcagaaactgctttttttcccccctcagtttaatcagaagccatatgaaaaaggacataggaatcttactgataaacccttagtaagatcgagtggttctactatctttggaaatgagcctgttgatgagagtatgtttgttgtttctgagacagagtctcactctgttgctcaggctggagtgcagtggtgcaatctgggctcactgcaacctccacctccccagttcaagcaattctcgtgcctcagcctctcgagtagctgggactacaggcacgcaccaccacgcccagctaatttttgtattttaaatagagacggttttgccatgttggccaggctgatctcaaactcctgacctcaagtgatccacctgccttggccccccaaagtgccgggattacaggagtgagccactgcacccggcctgatgaaagtatgttttcgttacgagcaactgtgtggtggctgcttcactgttttgggccactgtggctgaaacatctctcttgcccccaactccctaaaacctatggaatagataatccttttcaggtgcttgactttcccgacaggttcttccatgtgttcctaggaagatagcatcactgtttggagcccttacattatctttaatttaaatgttcaagtatatattttaaactatttgaatattgcttgataggcaaggcgcaaagcattttacacattaatgtcacatagttttagcccataggaattagaaaaggcagtccataataaatatttctaaacgactttttttgttcctctagcattctgtggaattgtagctattctgccttttatcacttattttaaactttgatacctgcttatttaatgggcattctcagttactctgataatagctcctaacaccatatgaattaagatatcctttctgctcatttttctttcactggcatattaacatatttagcgtttagcaaagtacatgtttttaacagaataggattttgttctgtcttcctatagtagcagatatttaatttttcactttatatgttatagttaaaatcaccctagtatttaatacctgggccgtgctgaaagcttcagtatttcagcctctagattctaaactttgacttttttactatacatatatatgtatatttatatatatacatatatataaaaataaagaaattaaggatgacatgggaagtaaaggcttccaaaaagctttactgaatagaagattaggactctcttcacatttcagtgcctcatatgtgcccctgaaaggcctaaggagtgggctggcctgaagaggtagaggcagaagaaaacaaagttggggaacaaatggaattcatttgtttctgaagttttcatgtgctagagtaactgcctccttcaatctagaaaaaatatgacaaaaatatttatatatgaatttatataggagtcttttatataaatcctggctctaccaattactagctttataactttaagaaaattatataacctctctgtgcctcagtttcctcatctataaactgggcacaatattagtacctaccttaaaggattgttaagaagaaggaatgagagaattctggtaaacaccgtactgttgtaatttttaccaggctggacaagactaagatcatggacatgactcgtttaacaggttgattcttacagtttcccttaccatgaaaacatagacacaaaatattctcagtgctctatgattaaaacggtagtatcttgtatggtagaacacagtccactactgcagctcgccactttatatgcagattttgtttatatgtggccattttgatgtccccattttacccgactattcctttaaaaacatatacataggacttcttaaacatgccctcttatggactaaggccgtattcttggtaatacccaatcattacaattaacatgaaacgcagttcttaaatgttgggcttgataatgactttcccacaattgctattttgggtcctttcttactagcctgaggaaatgacaagattgagaagcatgaacagacaactccagataaatgttgactgtacactgaaagaagttgacctccttcaatctagaggtatagacttgattatttggtaaaccataagtaatagtgtggtattttaagctgcttaaatagcaataactttggttttgtagatttaagagacagtttttatccgtaagattacaatcctgggaaagagatccccctgtcccatggtcatggatcagatttggggatgaaaaaatagttttacttcggcagtttcatcaagttcttatcatttagactgttctatgttgttactttgcatttatcctctttttgtcatttactgtgaatattttataaattgatgggttttaattctaaaacttagtagagttcatattatgtgatagacatctaaaatatctgtaaaaagggatcccaaatcagagtatcagatttctcagttttaaaataaactctatatatgttatttttcatgttatgttatgtgaaaacattcaactataatcatagttttagttttttggatttttttacagaagtatactacagcagaagctctcttaaactttcatttacccaactcaccagattagagatggtcttcattttctgtggaaaatatactgactgatgtccacagctgctgcatacttttgactagtaggctgcattctggtaggcccatgaatattgctcccatcggttgaattgtctgcttaccaagagttgattctgtccccaaacctgtttatgccagttattgtatttctgcaatttaatgtttcataaactgacatgaaggagaaagccgctctttctatgaaagccaaaggcaaatcactcaaaaaatagggattgtgaattagatatgggtgaaaacaactgaaaaaagtctaaaaggattctgtactcaaattgcattataagtgttcttaatatctttcttgctccattctaaagcaatcaaaattatagatgagggttcagcaaactagggcctgttgcctgtttctgtgaataaaagttttagtggagcgatagccatgcccatttgtttacatattgcctatggttgcctttgtgcttcaacagcacagttgactacttgcaacagagactctatcacaggtccacaaagtctaaaatattatctggcccttgacagaaaaggtttgccaacctctgctgtaggtcatcatgggtgtggtttatgtaagaaatacaatatggaaccccagccaacagacacgtaaaaattaggtctttatctaactaactttaaaatatagctatatacaagtgttttgttacgttaaagttgacgtgtaatttttcttaattctgtgtattaatcagctttcctgccccccatcccccacacttaacttttcttgattatggcagctaagactttctacagtgttttaagagtatataataaaatatctcactgccatttttaggcaagattaaacaaacagtaggctgggcacaatggctcatgcctgtattcccagcagtttgggaggccaaggtgagaggatcacttgagcctaagagttagagaccagcctgggcaacatagggagaccccatccctacaaataattttttaaaaattagctaggtgtggtggtgtgtgcctgtgatcccagctacgtgggaggctaaggcaggaggatcacctgagcccaggaggtcaaggctgcagtgagccgtgatcacaccgctgcactctagcctaggcaacagaaggagactcggtctaaaaaacaaagagcgagagattaaagattagtggcaggtgaacccaaaagacacggcattatctgaacaacagacagaagcaaatttgaatgtgagaattgagcaatctagtcaggtacccttaaagtcattttcagaagcctagtcactctatagcccactaacttgaagcaatcaaagaattactatgcatgatgtaggggttacataaactattgctactatattttagaagattgcatcaatttcttttacttgtgtggtctttggagcaaaacaaacagtaaaacatttggttaggatacttatagtaagccttttgtgatctagaaattagaacatgagctgtaacaagtaattgaagaaatacatatgcagcttcttaaagcataaaaagattcaattaatacatcaaatagcactgtggcttttatgagctatcacagcaattattttcagaaaattatcttaaaacagcatattcaagtggataaaacatttgtgaaagggcctgcaagggaaaccactattaaggttttataagcaaagagctgtgttttttgtctgcattggacaatgagctctttgggatacttaggcatttctaaatctcttttcataacgaatctaaatgtatccattttatactaaattctactcttccacactgcagaaaactttttatactgagtttccaatctaaacttttaagctagggaaggaatctaaacctttttcggtggtgacggggggaggcaggggaataagcatttagaatagatgcaaatcagtgcatgacttgatgaaaaccagcttttttgtgatttttggtaaggaaaacttgttgggaaaaaaaaaagtagatctggaaatgaagagatttaatatatttaaactatcagtattagtaccatacagcatcttctataaataagtatggctacagttaactgtaatcgtttagaacaagcagagcacagtgataggttcacagaagtgaaggcaggacccaaaaccaaccttggaggagacacagcaggagatgtggctgaaatacagacactagaccagggaatgaacatttgaagacagacaggtgaaaattttgtggcaagacaaaattctcaggtattgttctatctattctgaaattggcaccttttatcattgataaatctgtaggaaacatttaacacttagtgtaagattctccttttcttgaaaataagaatacataaactgctgatgttatttcacatttattgaggttgcttagtagtctcaaaatataacttgattaatccttgtaaatgtttatatttggctttttctgtagttcaatttataatgaatttttaaggtaaattatgataaatatgaaagtaagctttcattatttaagtgttctttctcacagtttgttcattaaaaatcaaaacaagcagaaagagaaaacagttcaaccatcctttcatttctcttcttcatttatctccccaaatgccccacatgcctaatcctgcctaaggagactagccttacaattagaaaaatattcctttaagtgtaatacattgtagacatacatctgtgtagtggttttcttgggtcttttctcacagcgatgaaaacacaatttcattgggaggacagaattatgtaatgaattttgaaatcctggaaaacatttttcccttcttatgtgttttatttacatattttctttaaaaaaaaatcaaataacaggaaaaaagagttcttaaatgcctgatgaatttactttctttataggaaactttgatccaaaagccatgaataatttttatgacaacatagaacctggcccagttgtaccacccaagccatctaaaaaaggtgagtatgaaaaatgtcacaaatacgatagaaataaatgtcaaaataatttgggatttcacatttatctgaagaaatttccactagaggttaagttgttcagcataaagttaccatatttttattatttttatttttttgagacagggtctcattctgctgccccagctagagtgcagtggtgtgatcatggctcattgcagcctcgaccttctgggctccagcgatctttctgcctcagcctcccaagtagctggtgtgtggcatggtaggcacacaccaccatgcccagctaatttttttttattttttgtagagatgggatctcaccatgttgctcactggtctcaacaaatttaccatattggtgttataatgtggcaataatgaaatgtccccaaactttagtttttaaaaagtactgaaattagtaactcttagaattactgtcagaggtaatttgatggactatataattttttacaaacagaagctgaaacactatattacatagttaacattataaatttacttagcattgtaaaaactataaccctaaaagataattctcataaaataatgaggattttaaaggtctaatgtgagaatagaaagttagatttgcaatagacttaagattatttttcagacaacaaaagaatacttgtgtactcaaaaggggagcatagcaattggtagcgactaggtattttcccatcaagaacaaaagaaatcctatataaccaaggtttgaaggaatcatttttggatagttgttacataaaaatgatttaaaattaaagatatcaaacatgttcttatttttatgtagcaaatgtttaattggcatttctgtatcttaaaaaattaattttaattgaatttacacgtgcagtcatttaagccagacggatggatcacatgaggccaggagttcgagactagcctggccaacatggcaaaaccccgtctctactaaaaatacaaaaattagccaggcctgatggcgcgcgcctgtaatcccagctactcaggtggctaaggcatgagaatcacttgaacccaggaggtggaggttgcagtgagccgagatcgcgccactgtactccagcctaggcgacagagaccctgtcatttattcattcattcataaataagtagtcattgaatgtagattaactttctgcctcattcttaatattttaatcctttttgccttaagcaactcaaggtagattgatcatgaagacacatagaacagtggagaatgccttatttttgaaaaaaattaccagagagtataacatttaacatctcatcagacttaattaaaagaatgtataaattctatctaaataatactacctgacctaattacttaaattttggttgaatagttttctacgtatattaagctcattacagagtgtttttttttttatttataagttgcaacatagtatctgttcttctttttattgtttaatattaccatcgatgtttcatctgatctacatttaaaaacagcctattgatttcttttttttttttgagatggagactctctctgtcacccaggctggaatgcagtggcactatctcagctcactgcaacctccacctcccaggttcaagtgattctcctgtctcagcctcccaagtagctgggattacccaccaccatgcccggctaatttttgtatttttagtagagacggcgtttcaccatggtggcgaggctggtcttgaactcttgacctcaagtgactcagcctcccaaagtgctgggattacaggcatgagctaccgcacctggccaaaaaatagtctattgatttctaaaaatggcacaaagaatcatcttagtggatgactgccgagtgccagatttggcactttggcagcatcatatgcagtttcttgccgaaagtcactgaggtgtatagttagcattgatcaatttagtcttttgggttcataaaatcagtctttaaactcgattttgcctgaatgtctactaaagaagtatcgccagacaaactttagttcattgattcaaagagctgtcttagagcaattgccctgtctaagggagtgcattggaaagtttttaccctggaaacaggaccaagttgattagaaatggtggaaaacacgtgcatcatgagccatccctcagcataaactccctataggtgtggtgtattagtctgttttcacgctgctgataaagacatacccaagactgggcgggcctcacaatcatcacagaaggcaaggaggagcaggtcacatcttaaagagagcttgtgcaggaaaactctcccttataataaccatcagatctcgtgagacttactatcacaagacctgcccccatgattcaattacctcccaccaggcccctcccacaatatgtgggaattcaagatgagatttgggtgggaacacagacaaaccatatcatgcggtctgagggacccaccataaataacaaagacactgccgttactcaggaaatttcaaggttttgagccagggacaaagccagacctctgtttgggcaaggcaaaattctttcccatgcgatagttaaagcagtgcttagaaggaaatttatagctttaaatgctcatgtaagacaggaatatctaaaattctaccttaagaaacaagacaagaacaaagtaaaaacaaagtagaagaaaggaaagtcaatgagatagaaaacagaaaaagttaacaaagcaagtttgatctttgaaaagataaacaaaatcaataaacttcaaggtagactgatctgtaaaaaaagagaacacaaattaccacaatcaaaagtgaaagatgggttatctattacaatgataatgataataagggaaagtgatggacatctttatgcagtaagcttgacaccttagataaagtggacagatttcctgaacaatataatctacccaaactgaaaacaagacaaaacagtaaatattagtaagtgtgtgtttttttaatatatattatatatatatatatatatatatatatataatatatatatgtataaagaaactgaatccactatcaaaattttcccccacaaagaaaactccagatccagatagattcactggtgggtaaattccaccaaatatttaagaaagtaaaaataccaatcttaaactctttgagaaaatacaggagggaacgcttcccgtatttcttttttgttttttcatttcatttccttttcatgttactgagaggaagttgcggagattttccatatacctcctgccccattatcagcatcctacaccagagtggtacgtttgtaacaattgatgaacttatattgagacctcataatcactcagagtccatagtttacattagggttcactgttggtgttgtaccccatctttttttatggcgctagcagaactctgattctaaaacctggtaaagacattatgtatctgcccctcacaaaaagaaaacaaaatttcagatcaataaacttcatgaacatagaaacaaaaaatccataattctgttttctatctcattgacttatagtcactatataaaaaaagataatacattatgaccaagttgagtttagcttaggaatataatcttggtataggcattaaaaaaccaaccagtgtaatttaccatattaaacaaagggaggaaaagcatgtgatcgtttcaccagatacaggaaaaacatttgacaaaattcaacagccattcctgacagacaaaaactttaaacaaattaagaatagaaaagaactctttcagtctcataaagggcatctttcaaaaacctttagctgccattattactgaataatgcaattctgaacttaccaacattgggaacaaggcaaggatgtctattctcaccacctttattcaacgttgtacctggagttcctagcccatgcagtaagagagaaaaaaaaaaagcataaatattggaaaagaagaaataaaactatatatactacagatgacataattatttttaaaatcctaaggatactggaaaacaactaactattagaactaataagtgaatttaacaaggcctcaggatgcaaagtcaatatataaacatgtttttacaatatcagtaaacacttggaaaataaaattcaagagaatttcatttacaataccatcaaaaaccatgtaacacttaggaataaatttatccagagatgtatacattgaaaactataaaacattgtcaaaagatatttaagaagacctaagtaaatggagtgatataccatgttcattaactgactgaatcaatatttttgagatacctgttcttacaaggttgatatatagatacagtgtaataccaattataaccccattaggtggtagtgcatttttaattaacaaactgattataaaattcatatggaaatacagaaagtcctagaacatccaaaacaatcttgaaaaagagcatccagaagtcttagactggctcagtgcaatggctcacacctgtaaacctagcattttgggagaccaaggcaggaggatcacttgagctcaggagttcgagactagcctgggcaacatagacctcatctacaaaaaaaaatttaaaaattagccagacatggtgtaattaaaagtgtatgaaaagtgtgttagtgtagagctaatttaaaaatagctcattgcagcctcacctatagtcccagctattctggtggctgaggcggtaggattgctggagcccaggaggttgaggctgcagtgagccgtgattgcagcactatactccagcctgggtgacaggctgtctccaaaaaggaaaaaaaagtcttagactaaccaacttcaggacttactataaagctacaataaccacagtgtgatattggtataggaataaacaaatagatcactggaacagaatagggagcccaggtttataccccccagtcacactgtcatttgatatttgacaaaagcaccaaagcaaccaatagacaaaggaacatttttttcaacaggcagagctggaagaactggatatccatgtggaagaaacacacagtctgatctctacctacctcacatcatacacaaaaatttgagatagctcatacacctaagtataaaagttaaactataaagcttccagaacagaatatctttgcaatttaggtataaaagtttttggacaggtcacaggaagcaataaaaagaaaaacaattgataaattagtcttcattaaagttttacacttctgctcatcaagtgacactattaagaaaatgaaaaggcaaaccacagaccaggagaaaatatttgtaaaatatgtatctgatgaaggatggtatccagagtatataaagaatttctacaacacagtaataaaaagacaactcaataaaaaagggtaaaacacttgaacagacacttgacaaaggaatatatatatgaaagaccatgaaaaaagaaatatcaaggaattttcctggggtaatcagatggatctgctgccaggatcctgtatagtcagattgtggttttctagcaatggtgatgttcgtgttaatatgtcattctgaggccagccttgtggctcatgcttataatctcagcactttgggaggcctgggagggagggaggatcacttgaggtctggagtttgagaccagcctgtccaacagggtgaaactccgtgtctactaaagataccaaaattagctgggcatggtggcgtggacctgtaatcctagctacttgggaggctgcggcagaagaatcacttgaacctgggaggtggaggttgcagtgagccgagatcgcaccactgcactccaacgtgggtgacagagcaagatgctgtctccaaaaaaaaaaaaaaaaaaaaaaaagatgtcattttgccttctgtctttgggaccaacaccatgtattcgaggtgggaggttcctgtttggtatcctccttggctgggcattgaataaggcttgcattaatattccatgatgtggtcccattaatatcaagcttcatctagcgctctacaagtacctttacactaaaaagactttgtttgtttgtttttgttttgagacagggtcccgctctgtcgcccaggctggagtgcagtggcatgatcatagctcattgcagcctcgacctcccaggctcaagccatcctcctgcctcagccacctgagtagctgggactacagacgcacaccaccacgcccggctaatttgtgtattttttgtggagacagggtttcgccatgttgcccgggctggtctcaaactcctgggctgaagcgatcctgctgccttggcctcccaaagtgctgcgattacaggcataagtcactgttcctggtctgaaagactcttttctatgactcatttaactcaaacacaatttgcaaaaactgatagtcccttagagttagttataatgggatttcggttaaaatttcttaaatatgtattgaatgctcaatgcgtagctcaattatgtagatagatgcttgctgttacacagggaaaacatgactcctaccccaagcagtttaatattctacatatgtacacttctaataaaaaagagactaggaagccatctcagtcatcttcactataaatgaatttctattttagaaatttagtagttgtaattctataataatatatattattggtgaaagtataaatggttctattatatgccaaattgtctttaacccgttttttatcttcttctgttaaaacttagaaacagtagaacttgattaaattctataattttttggtaagcctttcatcacaaatttataaaagctattcagttttctccataaaatcaagtttgttttccattaagcacttgcagattctcatattgtatttgaaactaaatcggcgttttctaaaagtacatatagtttagcacagattggcctgctattgcaggccactcaaatacaaaaagaaaaaagataaaccagtaaaacacaaattactggtagaataggtttattggttcgaataaataaatgtcttggagttattacagatatataccagaaatccaagtgtaattaatatagtttatctgaattctaagtgtgataattaaagaatgtgagggagacagaaggaaagagagagaaagagacagagaaacaaaccttttttggattggactttgtagttaagcaatacagtgtgtacgtgctcttcagcgggcttagaatgtctcccaacccttattagtaactcataacagtggtagattggactttgtagttaaacaatacagtgtgtatgtgtgctcttcagtgggcttagacagcttccccaaccttcatcagtaagcaagcaagcacactgaccttggtgtcccacgatctgagcactggtcctggtcatcttggccacctgaccttgttcaaactcaatctgagcaccatagagggacaatccagccaaatactccaaaggttgtaagagttagtgagataaggtatgtgactcgacagaagtactttgcaaatctaagaaacagaactttaccttattctttggagccttaaggagacattcactctgcttttgtttactcagacaatggagtatttaagtacctgagcaccatgctttggattctggagcagtgatttccaaagatgagttgtactgtgggctcagaattcattagaaaatgcaagatctttctttggttcctaagggcaaataatataaaggctgccatttttcatttttaatccaaagggttgcttactaataaactataaatttatagaaacaattttctagcaagatattaggatgcctacagttcttgtctgtgttgcaaagtgtctgctgggcttctgcacacataggtaattggaattcaggaaatgatttgggagcacgtggttgtcagtatatactattatatcgagttggttctgatttttcaagtactgctatttttaaaaaatccaccagacacagtggctcctgcctgtaataccaacactttgggaggctgaggtgggaggatcacttgaggccaggagtttgagaccagcctgggcaacatagcgagagaccctgtctctacaaaaaataaaatttaaaaaattagctgggcgtggtagtggcatgcacctgtagtcttggatacttgggaggctgaggcaggaggatcacttgagcccaggagatcaaggctgcagtgagccattattgtgccactgtactccagcctggacagcagaacaagaccctgtctcaaaaaaaacaaaaacaaaacaaaaaaaatcctgtcattttcatcacatttcatcattgtaatagccttactgtatggatagtgcccataattttaaaataatttttaaataattattgcttaatcagataattgctaaagtaaaatttcccaaattttgctttcacatcgacatttatttgctatcactgagtttgtacccctaatccattaaaaagtagaaaacagtgaaatagggcatttgttctaagtaatgggagaagatgtaactggagaagatggaaaaaagttgtaagaaccactgctctgtataggttgtaaaagcagtattaaatatggtgcctgcccttgctaaaggtaacatgaagtaataggtagggtaaatgcactcagctgtgtgggttgcttgaaagatcttgtgagcctgttcactcttgcagttgaaagactggatcacttctttctggcgttgtttatttttatgcagactcctcagacccctgcacaattgagagaaaagcccgaagaattagcgtgacctccaaagtacaggcagacatccatgacacccaggcagcagctgcagatggtttgtacttgtgtgtccagagtttgtgcagaatgtccaaagacacatgttaatccatgtagaattataagtaaaaccatacctttattttttgctttaaaaacattaccgagtttctaaggctgtgctgtccagtagaaatataatgcaagccacatatacaatttaaaattttctagtagcaaagatgaaattaatttttttttttttttttttttttgagacggagtctcgctctttaggccaggctggagtgcagtggcgctatcccggctcactgcaagctccgcctcctgggttcacaccattctcctgcctcagcctcctgtgtagctgggactacaggtgcctgccaccacgcccggctaattttttgtgtttttagtagagacggggtttcactgtgttagccaggatggtatcgatctcctgacctcgtgatccacccgcctcagcctcccaaagtgctgggattacaggcgtgagccaccgtgcctggccaaattttaatatatttttatataattcagtatatacaaaatattatttcaatatgaaatcaatataaaattatcagtgagatgttttacatcctttttatactaagtctttgaaatgtggtgtatattttacacttatagcaacattgagtttttagagcatgtctattaaaaaccagcaacagtaagatacgaatttttttttaagtgttacgtttttgggcatattgttcttttaaaaggtaaagacaaaagaggtccttttctgaaaatggcatagtaggccgggtgcggtggctcacacctgtaatcccagcactttgggaggccgaggcaggcggatcacgaggtcaggagatcgaaccatcctggctaacacggtgaaaccctgtctctactaaaaacacaaaaaattagccgggtgcggtggcaggcgcctgtagtcccagctacacaggaggctgaggcaggagaatggcgtgaacccaggaggcggagcttgcagtgagccgagatcacgccactgcactccagcctgggcaacagagcaagactccgtctcaaaaaaaaaaaaaaagaaagaaagaaaatggcatagtaaacatttttcctccaaccgaaggctttattcctccatatgagacaaaaaagaaaactgtattaaatctacatgttttggagtcatgagccaaaagacacaaggtgggtgataatggcagttaaaaagcaatagttgaagcaagagaaacaagcccatctcctatttatagtcataggaagcagctgaaaaacccagtaattttctgttatatcctaaggctaagatcaccttcctgtttgaggctgagcattatcataccttggggtaaggttcagggtctaaaattcagttctccttatctcttggggaatgttataacatttgtcatataaggcaaattgataaactagaagtcagcttgttaatttccagtggaagatatgcctagcccaaaatagtaactgacaaagcttccctagatctgtttcttttgttacctatttaaaaaggtgttgcttacctcagatcttaatctcatttccagttaccccagattccagggtgaattccatctggagatctttagtctcctatttattgacctcagtctcaatagagacctaaaagacagaaattacaggttaactctagatgcaaagagcttttttgagcacaaagccagagggaatgaggacctaagaggaatgtaagtttggatatctttttcaaatcctggggaccaacataaggttgccaggtatgggcatttttaaaaactgatatatgaaggatttttaatgccaaaaatgtaggaaagaatatgagaataaaagtcttttatactgaatgaatttagctttatgaaaaatgaactgtagaatcttcctcttttcactattctgaggaaaactttggtatgaactgccactgctatttatgaaccattaatataaaacatatgcatattgtagagcttaagttgtcatggaagaaggcacacatttagtcagatgtttaatatagtgtggatagtattatactatagagaggaaaagtcaaggtgggctgaagtcagggaaaacttacagaggcgacagaatttaacatgctataaaacatttctctttttcttcatttggctggaataaagcataactctccgctatttacaggtaatgacctaggaaggcaatctattctggacatatatccatcttcttatagcagaaaaaaagtaattagaacaaagtaaaagatcaactttctgttcaactatgcatttccagtagatatatttactaattggcttacatattaaagtaggcaattacctcccttgatttttgtggtatttttcttttcagtttggattatacttggaaaaaggttaatctatttaccttccccctcccccttaatcctaacctccctcagagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgt

SEQ ID NO: 4453 - DNA, 144747 bp, human; identical to SEQ ID NO: 4452

SEQ ID NO: 4454 - DNA, 144747 bp, human; identical to SEQ ID NO: 4452

SEQ ID NO: 4455 - DNA, 144747 bp, human; identical to SEQ ID NO: 4452
